United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 5

SEQ ID NO: 13286 - DNA, 1125000 bp, Homo sapiens
  misc_feature (1)...(1125000): n = A,T,C or G, or insertion/deletion polymorphism (see Tables 1-2)
ggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctartaatcaatgtgattcatttgtctttacaaaaacaaaccattcttttgttttgttttttttycttcaacttytactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttyatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaaccyaacaaataagttataagaaagggagaagaggccgggagtggtggctcatgyttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggagrttgcagtgagccaagattgtgccactgctctccagcctggtgaccgagtgagactctgtctcaaaaaaaaaaaaaaaaaatggagaagaaaatgtgatcatgataaccattcccgccattactggagcctggaccagccrgccagatttccacaggatgtctctgacctgcagaggggctrgcaaggtgggaggcatccagaccatgttacagaactcagtaatcagagcctgtgctggagccaccagcatcycaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcrgtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggsgggggggggtctcactatattgcccaggctggtcttgaactcctgggctcaagcaattctcctgccttggcctcccawagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagwacatttataggatatcttttggtggtccaagaggacttgagtgtaccttgtaaatacaggattttgtttttaattagattgattcacagagaaccaaacctaaggaatcacawcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcytcaggtaattagctatcctttctttcttttattttccttccttccttccttccttccttccttccttccttccttccttccttccttcctycctycctccctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatmctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatsacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtaytttttagtagcagtcctagatagcttcactatcatttcctgggaaagttttggaaaccccagcagagccttcatctttaactgtgtgaccttgggccattgaaataacgtttaatcttggttttttcacctgtaaaatgggttgataygagggtcagttcaggcactgtgcgtaaagcacatagcaccgtgtctagtaggtactctctgttccttaactgtckttccttgattrctcttaagatacgacartgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcarcctccgcctcccgggttcacgccattctcctgcctcagcctcccgagtagctgggactacaggcgcccgccaccacgcccggmtaagtttttgtgtttttagtagagacggggtttcaccgtgttagccaggatggtctcgatctcctgacctcgtgatcctcccgcctcggcctctcaaagtgctgggatyacaggcgtgagctaccgctcccggcctttttttttttttttttttttttttttttttaaagacagggtctcgctccgtcgcccaaactggagtgccgtggtgcgatctcggytcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacayaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcytttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatctgagtgtccccagtgcttggcaccyagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcktgccccctgygcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgtttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtcccygctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactycatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatrcctcttgtagcacctggctgtttcccttttgaaataattgtatgttttcctggataccttattacctggtgacacgtgtttctagttattgacctatgwttttaattataactttgggtggtggtctgaaatgaaatgttaagtttgacgcaaaaatmggactagtttgtgtaactgatttgttcaraataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgkggattttttkttttttaacagtcacaccgaggagaagactcagtgggawcatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcaygtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcrtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacarcgtatgttataggcagttctgaaggaaaggattcgatgactatctttttttggcacaaatgtgatccttctggaggccagaagatagattcagtgggccccagwtctttcaggtttaakgaataagcattttggtctatgaaaaatggggtttkcctaaagtataagattgtcttatatttataaatgcytstgttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctscagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcyttttcagmtatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagyactsttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgcsgactgctatgttagatactccagttcattsaaagtgatatcaccctaacattctctaaattagccacagcttagatgaaatttaggcaaatggaaygccccaggccccaggaagactgtggcagcacattgtatgtaactgttggggatgttgcctgaaacccccsccytttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttakcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaaccccgtctctastaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatataytttwaaaataaatttgtaatcatgtatacagtagtccccccttatccgtggtgtttcagtttttttttttttgagtcagagtattactctgttgcscaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgktgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctrctgtcagtgtgaacctgattagatctcaactgaaacttttttgtcacatgaggccatcagttgaatttcatgcctgcatgtaggtttagattttaattacttttttatggtgtcagcataacaaatgagagtcatacaaactrttgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatrtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttktttttttttkttttttttttttktttttttgagatgaagtcttcctctgttgcccaggctggagtgcagtggcgcattcttggctcactgcaaccttcgcctcccaggttgaagcaattcttctgcctcagcctctcgagtagctgggagtccaggcaccygccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatwtttttttcagyaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactrttggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtstggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagttkataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtrtgaatataaggttgctggcgtttggggaaaaatcatagttatagaagaaagactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctccagaactgtgttaaagamatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcraccctcataggatgtacttacaaatcctacrtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtmcacttgcctcagcctmccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctrttacgacttagccctgtagctctgrgctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttawtagagacggggtttcmccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcaractgctagaacctccagactgcatgtcatgcrtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcartgtacctagactgtttccttaaaraattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactattttttttttkgggtgcagtgaatacttcgcaatgcctgctgaattttacctattctgtaagtctttttgggaaccgttgagcccctcttctcttagttgcctttagcctttgtttttattatgrcaattggtatgaaatttttccttttcattacttcttttattcagagcacacctctgkcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacwaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgygttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccmgcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccrtatcttttgaaagaagattttttaaattccttatttttccttyctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaraatctgcaaggaggcagcatttaactgattagaattgtcgggggtggggttggcgagagggtgttgcttttctaatgattcacattgtataaaaagcagacagtaggtctggcactgttggctcatgcctgtaatcccagyacttygggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgygccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaasagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgrgcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtrgccctagatgttcattggcctgtggcagggtaattccagtctctgcctccatcwgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctrtaaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttcttttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctrcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcstttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacryatatatatatatacacacatatatatatatatatatayacacacacacacatatatatatatatatatatatatwtttttttttttttggagatggagttttactctgtcgcccaggctggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatatyaaccatctcagyaggcttcttcgtgttcacatagtctcctcaccgtgtgctgtgtccagatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttytggggagtacttgcctcccaagtgcttaggctcccgctgctgacaagaccctctgcctggsaagccstgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccrtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaakagtaacaaacacacacaagccactgttrgattttacaaaactttaaaaagtaattatcttaaagatatctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagamtttagtcttttcaagaggcaaagtaatataccacttttcgcttttttaatggtgagagccaaggtcaatctgaatttttctttttctttcttcctttttttttttttttttttttttwwwaaaaaaaaggtgcttgaattagaaaggtagcacaytgtccacatggacagtgcaggatggggctggctttttcatttctgagagctggcaatggaatgaaggtctttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctaytcgggaggctgaggcaggagaatggcgtgaacstgggaggcggagcttgcagtgagccgagattgcgccactgcactccagcctgggcgacagagcaagactcygtctcaaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggyggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggattttaggagctctgtgccaggaacctggatgaagacccartatgtatttcttattatatcacaatatcacaaatscacagtcacrtggtgattgtggtagtktggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaayaccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttrtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatatargcgtggtgtacwtcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattwaaaaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccarcctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacrgagttgctccccaatccttgatctttttttttttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcctccatggccacgtcawttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttarataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatytgatagaaaaacggcrtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggkggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcmcaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttcttwgggttcataggatctgtagtccttttctttatttttcatttttaaaaacaactttattgaggtatgattgaygtacaaaaagcctyacgtatttgaygtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcktttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttatttkttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatatacaaacgtacatttctgcttgtagcttgcacmyatatatatayacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtstatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagygcttgactgttgttgttttttttaattgtcaaatacacatgccrggctaaccatatggagatttyagtggagtgtgtaaagtttattgctcttggaatcatgtctttatttttaaagtcatcttcactttgtttgtcttatgaatgaaagcatgagcaagtcmattattattcacgcatttgtttgtagytcattgtcagtgtcatctgctttattagtcaggggtttgagaatgtttcttcctttaactcatttattaagaaaaataaaacgtggtgaacgcccatgattgcaactaggagactgttaygcttatggttgttaagattagaaagaaggargctttaaccctatctctratttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgyaggagatctsttrttagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgyccagctaatttttgtatttttaatacagacggagtttcaccatgttggcygggatagtctcgacctcctgatctcatgatctacacacctaggmctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctstgtatgccattatattgtgttcctcattttcccaagatgatgattatggwaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcmcttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttttgcattttccagacgagccaagrgatggctcagaarggtgaaggaactcacccgaattgcacagctggtgagctcagagtcagkctccttgcttggtccatctggcttccaaactscaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtygtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgmattatacactggtgccctcacctcttaagacaagcacctatcgttttcctgtgtattccaagaggccagtgtggctggtggaataagatgttttcctgttttcaagatgsagtggactctcttttatttarcagcagtgtctatgtgttaggaatccatgtgagttctctaagtctgggacaacgataggtgtgtctgagtcctgcattaccatggtttattctttcctttacccagtatstattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggsgcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgkwtataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgatwagcatcrgaaataatgactttaacattattttcagatagggagcactcagtaccaaccattatattaggctcatgggctcaacattttgctgtrcttttcatagatactgacacytgtgttttcattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttgggsggaggcatgtggtatgtggrgcgggtaaaatacgagcctcatgcctgtctaagctggtgacttggcttggaaaagatgatcattcgtcaaygcatcacaagtcacagggcttatctccattgttctgaacgatctgtagctaaacaaaaagataaaagctattaatattattaatagttgtagattacmgggaagarcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttkttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaraagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataatartaataataataataataakaakaatctgactaaggttattaaccattaaggtatgctgtgctaaggagcagggggccccttccatccgtagagggcagaaaggtgcctatcatgtcttcagtgtcagtgccctggtatggagctagctggccttccacaggktctggagttaatgctggagagaagtaggggtgkcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatgrcaggggaaccrtgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactraacagacttgcttagttcctgacattcaaggaagaactttaacrtccatccacggagcctcaaaggctaaaaataatcatccctttcaatagttcctgttgtgaggaccattaacaaattataagagaaagcattcctcacttgtakaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggastcrccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacytaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtrtatsttagggcttgtgggtaaatccagttgcacctggcagttggggcatatgttagggctagtgggtaaacccagccrcaccsgagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtrtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaacatgatrgcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggyacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctsgctgcagtgttggattttgtaggatggtgaccgtttacagaaacctctggtccgtgagccaatttggagaawattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacarcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatayggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcrcaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcargccacattagaaagcagttactttctcacccaattttaaaggagaaaggtaratgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagcygggattgtgccactgcactccagcctgggtgacagagcgagactctgtctcaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataayattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacrtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacarggagacagtaagaaaggtgacgtcaatctgagatgagagrgagagcaaaacagttcttttgaccaccttgaccccgaccttgaaataaggtggaactaataamtcccsctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacartgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccrgcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttgaaaaatatgccgccamaatatatcaatgtatggtcccaacgttttaggaagttgcatttaaaaaatcttggatacctgttttgtacatattatatatagcatcccgtgtgaatatgttaattcctttttatgagtttcggycttttttccctctcctatacatgattgctgttttatagctccagtttggtggaattaacatagatttcccacatggggaaggttttgggtgaggatttagaacaaggcaggttcttgatcctcggaagagattcttatctgagrggggawttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaaagaaagaaaacaaaaacaaataggacccatatccctggattgttgaggaaatacgtgaacatatgtggcacacattatagtgtctggcatacaataaatactttstaatgttactggtgtyttcttaccgttattgtctcactggtgaccgtttgaaatgttgaagctttattrttacagataatggtggatatagtstcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataacacatgtggctgagggttggccrtggctccacagtcacrggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcrtatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggkggtcttttcagtgatcagtcaccccattaaccacacatgaatggcacaagtaggaaatgcctgctcagagtccctggaagaggtatccagatttatggctcatcccagacttctctaatcgaggctgttttccctctagatgccttagtcaatcagtaattaatttgaaatccaaagtttcattaagtgttattgagttctcgcacactgacatttgtagtgctatatttctttaaaatcacaaaccatttttcatactgtcgtttgcatattttaacagaaaagattgtggttctggtgtgaatgacccagttttctggatatatttacttgaatgtcataaacttattatccttctcttccacttcattgcttttctgcttttctgaagtattttgaaatcatatttaaaacatcattatagcctctgaattctatctaaagcataactaaactttaccgggtgactgttttcaaaacaataccaagaagctggtcttatttagatctagtcttatatcattgaaatatcattagaattcttatggaaaatatgttttggctgtttagaggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtgrtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctctaactcccgatccttttaaacttcctctactctttttattcttagcacttagaacccactaacgctctatgtaactgtcttacgtgttccatttcttgtttctagactgtctccctccagtagaatgtgcgttctgctatacagcagtgytgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcmccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagascggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaarraaaaaaaaagattgaamatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtygtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagstctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttwaatttcttccattttctttcctttttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctsgctcctrgggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcrcatatgtcaatatgtaaacattttatatatatatatatgcatkcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctmaaacaaacaaacaaacaaacaaacaaactaagaacarcaacgaaaaaactcccatgtattatctatggattgactgtaaaatatgagaagcaataaatatgttcatcactagggccatctagaaatttctaacycaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgkactcyccacaaacctagttgatyccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcrtaggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatatamttaggcaaacttgtkttasttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccmccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatccyaggcagatgccacaaattattttgttttctttttgtatatatttatgctgtttcctcatttttaaatagtgggctttgatgactattcttctacataaattattacatatctgtatcatagaatcttaaaaattatttgattcaartgtatacataattttcatatccctgatagatattgccaaatatttaccagaagtgaatcaagtagtttttctaccaacattatctaagagggcttgtcttwttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattktcagcctgggtgacagaggaagaccctattacaaaaaaaaaaaaaaaaagggtctgttatcaacsatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatcygcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagwtctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcwggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggstttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggmtgctggactgtgtgcttagaatcwgtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcarctcctcttgagtgctttcaagatcagaccgaggggtcctagttcaagctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgycaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctyckggcaggacagtgaataaggggcacaacagagacacaaacacatsgctaaccaatggtctcatccgtcagccacactgcctgtctcagcatgggccctgtgtggaccattccatctcaatttgtttctgattcttgtcaattmaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcytccagggttcaagcgattctcctgcctcagcctcctgagtacctgggaccacaggcacatgccaccatgccagctaatttttagtagagatggggtttcaccatgttggcsaggctggtctcaaactcctgacctcaagtgatctgcctgccttggcctcctaaactgccgggattacaggtgtgagccaccacacccagcccctctccctattttaatgcgaggtaattaacaaccttaatttcaccrgtaacctgaattctcctttgccacgcagtctaccatattcacgggtttcagggattaggacctggacatctttggttgggaaatgggcatcattttgtctaccacaacgtgagagcccattgccctgcatccacagtcataaaagtstgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctraagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtktgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcycatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagamgtagataagaaaaacraatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatgrcattttcctgcttgattgtgaagatggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgytcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattytcctgcctcagcctcccaagtagctgggactacaggcacccgccaccaagcccagctaattttttgtaattttagtagagatggggtttcaccaygttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtartagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttytcatgacctctgctttttttgtctttaagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgrgctaattaagaaaactgtgcttcaatgtaattattccaccttaatgcatgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtatttttattctaatactgctattccttttactggtacytctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctyaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacrtttcccccagccttccctacctgctgagggctgctcccagcstaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatrtrtcattgaagtttcatccttcttcatttcagagtctgctrgaagacccttcatttaccactctctccttcctggaggtgtggaaatactctrcctgggtgaggctctcgtggctttttgtgccaagtgtccgtaaacttcaacttaattgttttaaatcctttgtggtgattatgyggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacraatcatagtgttsatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctctctatatgtatatctrtatatatatwtatctatatctrtatagakatatatatatatatatawaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtasctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactayaggtgcatgccaccacacccagctaatttttatattttttgtrgagatggggttttaccatgttgcctaggctggtctcgatctcctgggctctagcaatcctcccacctcggcctcccaaagtgttgggattacaggcgtgagctaccrtgcccggcsttacgtttcagcatctttcaatccrtctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaacyaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatrgactagggggctgatggaggggaacacctatcacaatatgtgttctcacaccaatgrtatatattttccacacatttagattctccatgccactccttatctctttagtgcagaaaacggagaggaggttcagtattcttaagaamctcccatgattgctttgaggcaatggatttaacrggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattrttrtcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgatttttttttcctgcacaatayggaattcagtgtttttatktaatcattcagtaagtcttgactgcctgctatggaggttaagccctttactaagttccaaggatgtacctgtgaataaggcaagttcctttttatcattgkctttgcagtctattaggggctacacaatttaaacagagaatatatataaaatggkagaaagtacaagtaagtataccttatttttttwaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacrtgatcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagtggtgctatttcggctaactgcaatctctgcctccygggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgrcgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttgagatggaktcttgctcttttgcccaggctggagtgcactatcgcgatctcggctcattgcaagctccgcctcccgggttcatgccattcttctgcctcagcctcccgagtagctgggactacaggcgcctgccactacacctgkctaatttttttgtagttttagtagrgatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcwtttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattmattttgatgtaggccttttaaaatcaattcctccctgtwattacaatgctgctttatggtatttgtgatatatcatrtgaatatacttgagggtcatgagaagttcatatgtgtgtgtgtagtgtgggccccagactttcgccayacygctggctaaagtggccatgtttttgtacgtctctgcagagcttacaagttattcaacagccagatttctattctgatatgcccttttagttttcaaagcatcgaaaaagggtaatctttagaaccraagtatttgsaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaasaaaacaaaacaaaaaaacaacaaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccartcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttktcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgawatccacagtggacaccagagagggtcatggaatctgrgaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaacsctatctctactaaaaatacaaaarttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgaytgatttatgtgcattgggcattttgttgatrtcattcagattaatgatggcactgaaaatgtgtaayggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaayagttyttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctygccrtgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcaccyacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgcygagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggarggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccayggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttrctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcayagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggctyagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgttatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttckagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtayggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcacygctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccrttcttttaacctygttcaggtggcgtggggcggtgtgtttggtggggagtgmtgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcrccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcargtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctcyatcctctatgtgtgtattagttcattcttgcactgctataaagaaatacctgagactgggtaatttatttaaaagacacctttaattggctcacagttccacaggctgtacaggaagcatrmtgctagcatctgcttggcttctggggaggcctcaggaaacttacaatcatggtggaaggcaaaggggaaggaaagcatctcacrtggtgcaaacaggagcaagagagggagcaagggggcaggtgcaaaacacttttcaacaaccagatctcaggagagccaactcaccacacagcatacgtgctaaaccatgcatgagaaatctgtcygcatgatctaatcaccttccaccaggccccacctccarcgttagggattacatttggacatgaaggctgggtgcggtggcacactctgtaatcccagcactttgggaggccgaggcaggtggattgcttgagctcagtcgtttgagaccatcctgcacaatacggtgaaamctcatctctactaaaatacaaaaatgtagccaggcgtggcrgcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaasagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgtwcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttatygggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctcsccctaacaacctctacctggcartcttcatttaactccaaactcaggacctcaatccyctgtttggcctgtgttccacgggacaggcatggggcacagakgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatgkttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccytttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttrgcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagaygagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagnnnnnnnnnnnnnnnnnnnntcggtttaggaacaacacaggattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttytgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttggttttttttttttttttttgtttgacacagggccctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcagaggagaaacagaartcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaagstaaggggtttgagaccagcctggccaacatggtgaaaccccatctstattaaaaatacataaattastcgggcatggtggcatgtrcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcstaggcaatgtaatgaccctctcctggcctcaattaactgaggccaggagagggtcattagcaaactgtcctttgctaaatgggactaatgggaagaatagtgtctgccawataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaacatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcannnnnnnnnnnnnnnnnnnnnnnnnnnnnnnnnnnnnnnnnnnnnncatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattmccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcracagttaaagagtattccagattcctccctccaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagktagaaatagagttttaaaaaactgtctgttcatatagttcatctgcttaataagtaarcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgamtgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcscaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggsgttgccagagaacttacacaggagcgtttctgctggaatcagctcgatgcctcttgaggacagagactcccagaggaaggagcrggcagccatccttrctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcycacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccrtctgtascaaacatacaaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtrtggtaaggtagatagatagatacatacatasatacatacatacatacatacatacatacatataaaattaggtaagaggatacttttaatgtatggtaagctatgattgcaccactgcattctagcctaggcgacagagcaagaccctgtctctaaaaataaataaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttytaaaacatgttgtatgtgggcccatttgccatgtgtgtgtgtgtgtctgtctatctatctatctatgtatatatatatatatatatatatatatatatatatatatatatasttataatgtggtgggttctcgaatcacagttgtaattcacatttttctccaccaattctgataacttgcattaagaaattgmctgtgtaagttaaattttagatcaataatgcaaattgsaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatasagagcattctgttagatacagagaatctctggtagatayaaagtattctgctattctgatcttcctkttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttscatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccayagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagagagagagagaaagraaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttttkttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcycccaccgccagccctgcttaaattatcccctctttttaaacaraatatcctaatcttgsaagtggcatatcatgttccttcttttttaagagagaaggagaaattcctgcagatcatcagggactgaggctaactgaarctttggaatggatacagtgctactctcagctgaaagcacaaatcacttccatcacgtatatgagattcctacttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctcnnnnnnnnnnnnnnnnnnnnnnnnnnnnnnnnnnnnnnnnnnnnncctttcctcccctcccctcccttcccttccctttctttctttctttcttttttttttttttttcagacagaaatctcactccgtcgtccaggttggagtgcagtggcacgatctcagctcactccaacctctgcctgccgggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcrtggtggtgcatgcctgtaatcccagctacttgggaggctgaggcaggagaattgcttgagtctgggaggcggaggttgcagtcagctgagattgtgcygttgcactccagcctgggcaacaagagcgaaactccatgtcaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaarttccagagagatctgaagtagttttattggaacacagycctacacaccttcatttataagctatctgtggctacttttgcactatgccagcaaagttgagtagttgggatggagactrtatggcccataaagcctaaaatactctctgctcctttccagaaagcttggcaacccctactrtcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttattyttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaascctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctrtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcrggctgtttgaaaacacacacacacagttttccagtggctaatttgaaaaatgtcaccgtattagttttcatttacatctgtcaggaaacatatctatacataaggaagtttttttttttttttttttttttttactttcaccaggtatttttttgtggagtatgcatttaattcacatttacaaattggtttctgtttttaactaaagrtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttstaagcttggggctcytcagccatgactgaaacgtacyatgagcacggcatctaccgggctgttccacatcctccctgtgkgactaggggccagggcaatgggaatcagtgcagaaataaagctcatgctgtttgctstgccatgagtaacgaagtcctctrtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacartgtgctgaggtttcacattgttacatcctacaagcgtgcttacctgcatcaccttgctggsctgtttcagcattggaatatcactgggaatctcaagttcccaggagccaaccacragagcttcacagctcagaattttcaagatgtggatgtaggcagggagcctatgtagtaattcaagtaarcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctstaagttrgggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacrttcccatttttacctataacagcagtagcaataatgctaatagtaatgatactagtaataaratcaggataatgctgtttttaattcaccacactgtatgccatttgcttaaaatcagaaaggactcatcggtraggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgkaccctgaattggccctagcctagttktccaaactttatccccaggtggttgaactttctaagtttcccsaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggmcagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcagkttagaattcctgttgratatccctctggccygaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtragagagcctttcccttctctttggctcgttttcagtttttattaatttcctgtgcttctggttcatgaatcccaagtcatgatgtgaatcagttcagttcagcaagcactgagctcccaygatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcrcagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaragttcctgggcttcattctgctttgcattcatctcaaagttaagccttctggctggcaggggtttctgagacagwctgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgrcaatgataataattataacccaagcgacacatacaatttaatcaggcactgtgtgtccacagcgatgtcaaggaamaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagmaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttamtgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacatwacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcdgccagtggtcactgcagtttaacaraytccccccgggtgtgaaggaaagcgagataaatgcaggaaaaaggatacattttgaaatctggaaattttacataacaggcatcagatttgaagaatgtccaaaatattacgartcatagcacaacctttgctaacaccrtggaaatttttraacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttktatcttamagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaratgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaawtatttctgaacagaactaacatcagaatcatctgaatcatcagaattgtgtattttggaaaaatcggattcatcaaatgaatcttcagccaacaactgttcgagaatkatgttaacatcacatgcaggaatgctacattttctcggatttgacattttcagtgatggagaactattatattttgtaaatggaaataccactactaaaaacagaaggctataaatagaaygatatccttcgtttccaaagtcgatatgctagagtgatgtgaaaaaaataataaaagcgagatatttcatggcaaagcgatctcagggtaaacactgcacaccagtaagtattcttgggkcaaatgggaaaagggttaaaatgaccagatctccagagatctcmctcactrtggtgaagacagcgccaagccatgagggctcygccccagtgattcaaatacctcccattacggacatgtttcaacatgagatttgrgcrgggacaaatatccaaactatatcaggatcccagcagactgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcraaaacaggcataaacgayatgtaaaggagcargcatggctgcgagaaactttatttatggatactggaatttgaatttcatatacattttcatgtgtcacaaaatattattctttcccccccgcccccarccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttayttawtcccttagttttgatgatcttttatgggttatattcttcaaagggaaaattctctccraatggggctgccrctggcagrcgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacrgagtctgagaggccccgttccctaatggwaaaatgaggtccaattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcaraaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaartgagaagagtggcttagaacagggaaaatgtggccgggcgcagtggctcacgcctgtaatctcagcactttgggaggcctagrtgcgcagattacraggtcaggmgattgaggccaggctggccaatrtgatgtgagaccccatgtctactaaaaatacaaaaaattagccgggagtggtggtgttcgcctgtagtcccagttactcaggaggctgagccaggagaatcgcttgaacctsggaggtggaggttgyagtgagccgagatcgtgccgttgcactccagcctgagtgacaagagcaacactccatctcaaaaaaaaaaaaaaaaaaaaaaggacagggaaaatgtccaggaaggatgtggcttagctgaagatcwgcttcagcttgatcccacgggaagctctggagggtgaattstacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaayggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattccyaaacttacatgttaacataaacatggagctcagaggaaatgtgttgtttgagatgaaccatcgtttcaaatgtcacttacttcttgttttataaagtatcattactcttttcttggacacagtctcatctttgaggwgtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcataygatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaaywaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcrcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtacccyatacctattagascatcataaaatataactatatgagtatcatagaaaagtttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataraataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacscagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccmatcccttgtattttagaagagcctgatacatttgcaaggwctctctttatattcctgaattttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactwtgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacraagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttrttacatttttactgtgcattcatgtgcacacacacacttttaagcatttttgatttatatawccctctgcatattttgtgccttgtgatgtgtttaacgaatgacagtgtctttagtgcattgctryttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacartgcactttctctctctctttcttcttttggtttatgatgtttttcartagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctamcgtttcttgggattttcagaaaggattggcttggctttttatcaaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccrccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaasaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatctttttttttwaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccattycagtctgatcyggtcaattctggtaggacttcatccaagcacaaagaaacctttgttttcattcaagacttccctaaaaggtggctgggtgcggtgcctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaamaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggaygggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctckaaggtctcctggkaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcragtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtaccbccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatwtgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagayggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttstctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaattatgtccttctagmttgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgawgaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggstattactcagtgggtgccgtaacatgkctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctscacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaatyttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacrtttatccatccatctacccacccatccrtccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctsattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcytattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagagacgggatttctgcatgttggtcaggctggcctcaaactcccgacctgagatgattcacttggccttggmctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattrctcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgygtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctctttttttttcttttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagcyscagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatcsaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatsatggtrtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttrccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcscattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcmtaacccatttccaaccttctgggttttttccttcaacgtttcctgtgacagttctccattatatctttgttagataatagttagcaaccmattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcastagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccktggtctttttrtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatcccsacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcartgtctgtcttgtggtcctgaagtctaactctaatcctggctccactayctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatyttcccttcctcctccttccccctccttccccctctctttttccttttctttctatcatcatccatagctctcttgccccattgttttaaacccatctgtttttgttkctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcwgaaatgcagatgagtgggcctaaagaatccagactcaacttacttctagtggtaatggctgtaggagagatggggagtaggagaagaaaagccaaaggcagactttagtctggtttataatgctttaatwtttttttgaaggaagaaaaatgttcattacttaaygtaataattatttttaaaaagcagcctggsgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgyctcctcctcttayttttaaggacccttgtsatttcattggtctcagctggatagctatcaagggtcactttaaggtcagctgactagcaaacctaattctatctgcaacctkaattcatataacctggcgtagtctcgattttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaarttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctraacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaacccacgacgcagaggttgcagtgagccgagatcgagccactgcactccagcctgagcaacagagtgagactctgtctcaaaaaaaaaaaaaaaaaaaaagtacaggacatacgtaggacccctgaacatttatccccctgctgnnnnnnnnnnnnnnnnnnnnnnnnnnnnnnnnnnnnnnnnnnnnnnnnnnnnnnnnnnnnnnnnnnnncagcccccttagtagctgggactacaggcacaccccaccctgcaggggttttttttttttgtttttttgtttttttgtttttttttttgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgygatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttmtttttcagcctgggtttgaaagcaaagtggtagtgactttttcctgatagctgctgaaaaggttccacrgtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagstataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcytggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctrctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatatacgtatatatatacgtatatatatgcgtatatatatacgtatatatgcgtatatatatayrtatatatgcgtatatatatacgtatatatacgtatatatgcgtrtatatatacgtatatatacgtatatatatatrtgtgtrtatatatatatawaaatatatttaaataatgttaaggctagagtagaatgacatcatgggaaggcttattgaaacttggagtggattcgtagtctgccacgagaatccttgtctgatgtttgtgggtstgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcaccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaaccnnnnnnnnnnnnnnnnnnnntaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaatgagtatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcagcctcagcctcctaaagtgctgggattacaggcgtgagccactgygcccggccggggatcttgtattaatartagggagacagtaagcaagcaaggctcagttaatgataaattgttatcaggagacccagcagtttctgctttttctaccctcctctttgasctctatttaaactaataggttactgggtttsaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtrtgcatatgctcagttrcagaaacctaaattgctaaattgcaaggctgtatatgatatgccaatttggcatattctgtctttttatattctgccacccctatcatacttakgaaaatgccaggttgtaatcattcactgggagaaacaaggggttgaacrttgttatygcrcaaaggaagctgggcctagtaaaggaatgtaaatactaaaatgccagcatcactgttacttactgtgtttctctggatgtattacttaacctctctggctttatttctgccygccctccccccgccccccccccssaatgcctcaatctgtggcagagttgttacattattgaaaaagaacataaagcatattttctggcatacagcatatgtttaatttataatttttgtttttatcattaaaagcaacagattgctgtattcttgcctgccactgacatggacttaattgtttcatttagacatttaartgggcaatacacttaaaatgcagatataactttaattgtcaaaacatgcttattttaggaaatgtgtttctccagtaaagctcagtatctggggctttttcggttgtattctatatgaatcttgaatactgaagtttctcaccatggagatgacaaacacataaaatgtttactttgcaaactgaatttctcttgctgctttttctgaagttccccagaggctcatcatcatcaataccatcaattaatagtcatccttggcttcctcgatcctcagcactgcgctgggcactgccccccaggagcatccatgcacctcaaatcctgaccttgtgactttcaagtccctaagtgaccccacactgaagaatctggtgaaggccatccaagcccagagttcatttaagtggcagcgatgggaccaaattataggccaggtctgtcttatgaaagatgataaatggatgtgtcatatcgggaaagaartcactctgtcatcatatgacaggctggcttgatttctttgcaccagtgtccctaaaagttgggatgggggtgtgaagcgtgccagctttcaaagccagttgtcactccattttgtgctgtacctccccagttatgaatctggggcatcttcactggactctccaagccccagtaccctcagtgtggaaggagaaagcatgacccactgggcaggacacagaaggcttctgtgagaatgaagctctatcatgcttgtagaacatggagcgctcagcaaatacaaatcacagcccatctcctccaatcatttggggtattaggattcccttcactccaactcccactggaaaacctctttgccatgacacagagattccacaaycttctatttttatttaaaaatttttttaaagagtgatctttggttttctcagtagatgctttcctctgaatagcaagcatatagatagtcttctccttcagacccmcgaccatggctatattatttagtctacagtggttctttgtacaaagtgcttctgcaaagctcttagagcacccagagctggctttggaaagcaagacattaggaatgagctagcctgaatgagtcctgatttttttttttttttttttttttttttgagatgatcttcttctgttgcccaggctggagtacagttgtacaatcttggctcatggcaacctcaaacttctgggctcaagccagccgcccatctcagctacttagtagcttggattatgggtttgtaccaccttgcctggctaatttgtatttttagtagagatgacattttgccatgttggccaggctggtcttgaactcctggcctcatgtgattgccccaacctcagcctcccaaagtgttgggattataggtgtgagcctctgtacctgagttctgatttcttaaatttcacagtcccttacctgtaactcaaattcccgaaccttcaaaaaacaacaagtggcagcaaaacttgatttggaattgtcgtggtcttgtttataatcgtcatttttcttgtcatgtgatttgatgtttgggtatatgttaacacctcactagggatatttcatagcatatgattgatgtaagtcgtaaaaaatttagaatccttcaacacatacttggattttagatgaagaatcatagatttttatttctgtggctttggatgagctgtttaattttcatttcaagttgctggtaagatgatgatgataatagagataatcctgtaagaatgctgcaaagggttagtactttattcttgcaacaagtatttattgtaggcctgtattcaaaggagaataagataaataagatcgaatgtggaaattagatgaatccggagttagtgcaatgaaagttactaagagagaacagaaatactcttgataatgctgatgtgactggacttttgacaagcagtctgggacttctgctgaaaagtgctcttgaagccaagcaaaatcatttccacaccctcagcacytccagtttttcctggccttggtctcagggtggttgaccttttgccgatgtgtttttctttcttttcttttcttttcttttgktttcttttcttttctcttctcttcttttcttttytaacagtcttgctctgtcttccaggctggagtgcagtggtgcgatctcagctcactgcagcctctgccccctgggttgaagcgattctcctgcctcagcctcccgagtacctgggactacaggckcccatcaccatgacaggctgattttcttttttttcgtaggacgaggtttcagcatgttcgccaggctggtcttggattcctgatctcacatgattcaccaaccttggcctcccaaagtgctgggattacaggtgtgagctaccgcacccagcctgctgatatatttttaattatcataagaaacagttaaagtgaaattgcaaccccatggtatcggtggactgaacgtttggttctcatttccttgagatggtagtttcctcctctggctacttttgtccagccagttctcctctgtgggcatttggggaagggctctctgatagaaatatgaaatgatgagggatgcaaaaaacgtggtttgtttcttagaacaacctccaccacgaaggttccagacagagtgaaatttctgtatttgctgaccctgtcgccagtagcctggaataaacagcaaaaatagttcttgaggcttygtggcaaatgtgacctacctttgtagttcttgggtaggtgtgtgactgtggcctatgaggccaagttgcaaggtctttggatgaactttgtggcatctggcaatgtccccagtgcaacytatgtaaaatatagcagtttcctgcacacgcttaagggaagaaaccgttgtggggaagcgtgctctgttattcttgccaatgtagccaacatatacatggggaggtctgttttatgttttatgtttgatggttttttctttttctttcttttttttttttttgagacagggccttgctttgtcaccctggctcaagtgcagtggtagaatcatagstcactgcagcctcaaactcttkggctccagtgatyctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtawatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgrtaattttttttttttttcccctgagaaagtcttgctctgttgccaggctatagtgcastggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggaygctctcgatcttttgaccwcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttrcgacttcatttgtactttcaaacttcctcctggaaacagaagaaaataaaattagatttttgtaagctgagatgatatgcatgttcttattttcaatacagttagtctctccactttatttttaaacacaacctcataatacaaataatctagtcttttctggagcagtctatttattcagacaggtggaagttgatgctaaagattggcgttaaattgagtaaaccattcatgtagtaaataagataatttgtttctgccccccaaaagattaaaatayagatttttttcaaagtctgtttttttaacacctacggtccctgaatatgttcgattgaggtttgtgtctgtaatttggaacggctttttgttgcaactaaaatattcatttgcagaaattatcactgagggtgttagcttcttyatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacrttctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctrgctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttccsagaaagactggaaacttgcctaaagagacagaatcccagatcccagatggatctactattttagaatctcygcttccgcatttctaaaatccttcccagagaattatttgactagttaaagcttaagaaacaccccagtggattatgagtgccttctagccaagaatgggtatttcctctgtgcaatctgagggcmcgggacactcctccagcggagtagcctgtgatttgtatgggctgcatgaattcctgcactaacaaggtaaaagaaggatgttaaagaaaacccgagatcttttgggtacatgctataaggtgaaaggcttatttccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggcwgaggctcagaaatttaaaattgcttcatgtcgcacagttcagtgtaaagttgcaatgcaaactaagatgtttcygttgcttataatcttaactataataatcataaaccatgttctgttgctcagaacccttgtacttataatataaaacaatctttttaaccaagattcttcgcttgggtattctgagtagcatggaagagcattatactttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacrggagcatactmccacacccaggtaatttttcatttttggtagagacggcgtttcaccgtgttggccaggcttgtctcaacccctgagctcaggtgatccgcctgccttggcctgccaaagtgmtgggattacagacatgagccaccaaacctggtcaattttctatggkgtgtgttacattttttaaaattttattttamtgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttsatacacatgaaataaaatttcaaatggttcctctgttcmgcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcgcgcgcgcrcacacayacacacacacacacacacacasaaaatcaccaaatcacacctgaacaagaggaagaaaattaaactcattgaggagataccatcttttttaaaaaaaaaaaaaaaaggcagcaaaatgtgagatggscgtttattatgagatacacgaagacagagaccagaggttccccaagtagcccctggacctgcagtgtcagcatcacctggtagcttgttagacatagaaattcttgggctttattccasacataatgaatcagaagcttrtggggtgrggcctgcagtctgasgtttattttttctaaaactttaagttycagggtacatgtgtaagatgtgcaagtttgttacataggtaatcatctgccacggtggtttgctgcagagatcaacttatcrcctggrtatgaagcccagcgtccattagctgttsttgctgatgctcttcccaccacctgcaagycccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttctggctctgcagaactgaggtgggccccaaaacttgmgtttctaaaaggtactasctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgcacacctgtagtcccagytatttggaaggctggggcaggagaatcgcttgaacctgggaggcagatgttgcagtgagcyragatcaggccactgcactccaacctgggtgacagagycagagtctgtytcaaaaaacgaaaaacaaaaaaaaccaaaaractaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaaaagcctacagttgacaggcagataacagagggagcaaaggagtcttgtggaagacaatagggagtgttgaggacctgtcaaacaacasagtccccatctgtactttgggagggaaggacttcttaattccagctgcctgttgccatgggggaacatagacscagaactgccatcytttctaatttttttaaaaattagaggctaaaagttttggcttataaaaatggtatttcctgagtttttacaattayagtattaagatattcctaggtttttgtttgttttcgagasgaagtttcgctctcatttcccaggatggagtgcagtggtgcaatctcctccgcctcccagtttaagccattctcctgcctcagcctcctragtagctgggattacaggckcccgccaccatgcccggctaattttttgtattttttagtacagacggggtttcagcatgttggccaggctggtctcaaactcctgacctcacrtgatccacccgccttggcctcctaaagggttgggattacaggtgtcagctagtgcacctgaccctaggataatcttaattttaagtarctggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatygcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccartttcatacagcgtagtttcacgcctctaaaagtcccctgaaagtgttattaaaagtactatctggccatgtcctcatttccccagcaaagtccttctgagaatttaggckctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacstcagtggtasagctgrtgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagcyttctggaaaggagagatggtractaatttaggcagtgtcttttgctttcacawggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctrgtgagcaggtggaaatgtagacacccaaacacccttcatggattcccagctsctgasagtttgaatagtatgtgaagtctgtagagacaaaattgttgttttccccagtygtaaagtgtgcaatattatccttgcaaaattgtctgtttawtttttttgcccttttgggggacaaaatgtctttatgttaaattgttttattattgttatctttatggagttaagggcacataaaatattcttacagagagarattctgtagtttccacaagtaaccagagaattgttcawggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatrtgtgattgtctacatgttyacaagttaccgcctttttatttcttctctttttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttcygcatcatatcmatatagtgatawcatgtataatgatgtttaagaagacagttwtttttgtttaaattgttataaataagtaagtgtatgcaccactatgccatgtagcatatcaagattatttttctttcctgcaccttatwttttccctggagttaatactcatctttttttagaaatttgctgagtttktgatgtacctatcattcaacctcaaactttcatgtgattgtctaaatctcagttccttttattagaaaaaaaaaaaaaaacaactcccctggagcctttgtaccttctgyagtttggggttgttgtcctttttgcttggtgcacrggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggnnnnnnnnnnnnnnnnnnnnacgttttctatttcctttatgtttgataacattctattcttgtttccatggatgatgttactcttttaactctctgatgttaatgataattgttttaatttttcttttctgtttagtttctatcttctcaaaattgttttcatttgttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatccyasagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttakgaaatgatggtatcctgctgggctgagtggggagggattctcaagctgtacatrgctgacacacagstttctaaaaggttgtctttcamccccattttcagaagtaccasgttccacattttctgagcctttgctggctctctgataggaattgtgttacttctcagctgtccccatggctagcttaagactcagctctcttaagtcacttcctagttgtccatctgctttccagcatccaactgtaattttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgkgatttgggatgaaaattttaaaaaatmaatatgtataatccaccatctttgttccttttatttttatgttactcattcttttaagcttgtcttrgacgtgagtattatgttttattttgctgggagaacaatttgggaaaatttgagcagcaaaccataagtttcttggtgtctgtgtacttggagctctgaatcaytattgtcactgagggagtggacaggaagtgatgctgagataagtctagatgggataggtgggcaacatgcaggagaaacctcctgggaaaggtgagcaagagcacacaggtgagacatagcatcgagtrtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttnggaggctgaggcagcagaatggcttgagcctgggagatcaaggctacagtgagctgcaattgtgccactgcactctaatttaggcagcagaatgagactrtgtctcaagaaaatgttcaagaagaaatacaaactattgaaaaaggaaggctgaatgctttatcagaaaactgtatttrgaggggacctttctggggtcttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactrtcattctgccatcaacaccgaggtgtcggagtagcagkagagccacatatttcttagtgaggggacccagaatgatcccttttgtgctagaggatctgagttcatttcatgaaactgaagcatcttcttggagmtataagctcaccttgggatrggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgrcaccatgactctgytttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaycatttttggtgggacctgaagatgtatatcccttgtttkcagattcctcgcctctcatcatgtaaggtgatgctctgagctggktcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgytstcagttctttgtcattcagctgctttaatattaatatgacaccmgttttgggcttgaaaagttttccttctgctgagaaatgrtgatggtgacaatgatgacaatgacgatgacccttggttggagcaatgtagtctaaatgtggttgcatcatcttctttcttcctttgycttcctcccttgctctttttctgcccctcatgcckgctccttcctcccacatcaccccacatttttttttctttctcctcaccatcaagaaatgttccagaatgccattattcttcgtcaccacggtcaggtrtatcatcctaagggcagagggtgaaggtgmgtaattagtgtttsaccagactgagcatcatcctcggtgcaggggagaatggctggtatttatgagtgaatggcagcgttttgacaggatgatgaataaatatgcygggcccagaggactccaggtgataagcatttctttgtggtctggtaagtgatagyacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctrtgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattggcctggatgtcgttttctcataaagttgactatggctattggtggtactagtatgnnnnnnnnnnnnnnnnnnnngagcagtacatgggggtatacagagtgcaggcctcagaactgcagaacatctgcacaatctccagcaagctaacctctgtggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttactygcttggattggtttgatcaactttgttgcggtctaatttatgtawaataaattgcatccatttaaatatacaattcaatgagttttgacagatgcacatgcccatgaaaccaacacgaaaataaaaaaaawagaacatttacrtcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataatkaccttgggatgtacccatactgctgcctgtatcagtggcttactcattgtcattggtgagtagtactccattgtgtggagaaatcacattgttttaaaaatacctaattacctgctgatagacatttgggttstkcccagtttttagctgttgtaaatggatactaatgtgaacgaagccaccgtgaatattgatgcactagtctttgtgtggacatatatctgttttatcttgggggataatactctggartggaatgggcagggtggtccgtatagggctatgtataactttttaagaggttggcaaatacttccctaaagtggtcatcccattttacrttcttgccaacagtgtttaaggatccacttcctctacatccttaataatacttgatattatyggtcttctaaattttctgtttgggtacatagtggtattttgttgtatatwtttttttaattgtgaaatatgtgastatgatgagtaatgattttgaacatgaaaactatgcttattgctcatatctatgttattttattatttactttttttgagatggagtctcgytctgttgcccagtctggrgagcagtggtgtgatcttggtttactgcaacctctgcctactgggttcaagcgattttcctgcctcagtctcttgagtagctggtgttacagaagcctgctaccatgcctggctaatttttgtgttgttttattttwattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgsgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatrctccttcccctgtagatcatacccattcccaagatttcagtcatcaaatccattccaatatgactcctgtatccatatgtcyagttccaagtatctgtccatggtgttggtcccakgttattcgcacctcatatgtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttstacatatcttaaaagtggattcctcataaaacaatatggactatggtcttattctstttaacggtatgaargctcgcctgaaaggccaagagtaagattcttttaaaatcatgcccaagttttaaaggaatataaaactttctctttaaaaatatacctttctgcttycatcccytaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagraaaaagatcatagagccaaagagctcgatacatatactgatgcggtgtttattttattttagttttttgagacagggtctctgtcgctcaggctggattragtgcagtgaatcttggctcactgtagcttytgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatracttgaacaacaaaaatacattttctcatagttgtggagcctagaattccaaggtcaaggtkccggcacagttgatgtctwctgaggtctmcctcgtctgcttgcagacagccgccttcccaccgtgttctcacgtgacctagccgctgtgtgcaygcatccctggttwcttttcctgtgttcagatgtcctcttctttgaaggacaccastcagattgcaataggacctgccctgatagcctcattttttacataatcacctctttataggcygtacctccaaatacagtcacattctgaggtagtasgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccrtttatccatggattggtatgagccctaatggtgcacccttccgacaatccttcatccttcccagacgtttcatcagccargtgaaatttgcaattgtttcwgtgattgaaattatgcttggagtgcaggtgtcaysgatgaaacagcaatgccttgcggtgacaaattcagtgtagaaataattttagcaagcccagtgattggaaaacaatgactcaactttragctatattgattttgtatttctgggctcagcttttgactcagtctcattccccagaaataatccctgttaacatttcggtttgtgttatggaagtgttytctcttctatgaattasctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaartgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctygatccttacacttagcatcatgttttcaagggtyattcatgttgtagcatgtatcagtacttctttttttagggctgagtaatattccatttacggatatgccacatttcatctatgcattcagttcayggacatgtrggttgtttccacattttggctattgtgcataatgcttccaggtacacttgtctacacatttttgtgtggatataggtttwccttttttggggtatgctcctaagagtgcaatttctggatcacgkggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactrtggccatgaaaccttgcctggcccccagggatggggtgaggggggatatcatataygctttaggtggggcagaggggtggtctgcccctgtgcaggcaggaatgttcaggaagcaggctgcctctgtttctactctaaatatttaacattcacggatggcatggatcctsactaagcggagcagatgctggctctrtattgcacatagctcctgaatatcagccctgcktggctatgcatgtgttttttgttagtttttgagacagagtctcggtctcttgcccaggctggaatgcagtggcacgatgttggctcactgcaaaccctgcctcccaggttcaagygattctcctctcccagcctcccgagtctctgggattacagacgtgyatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtsgtggagatggtggcgcacaagagggtcagtgccccatctcaaggaacagctgcacctcrgcctaygcgattgtgaaaaygtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcawtgttagtgacttakaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgsgataatctgcctrtttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtctttattttatgtccttggagtgtatagcagagttagatagatcyttctggattggcggttgattgaatattggctgtacaaagaaactggwtaggagtatagagaaaagatcaatcatagcactagcttatagtttattttattctttaatgattttttaaaaatatttctctcacttacttgaaaagcagtcttagaaattaactggaatgggtaatttattygtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattrggattaagggaaaatcaagtaaaycgagaggtaaagcactgtgcagaaatattggccagaagctatgaacagwtgccacagctgggctgaagagttacctgtsagccttccaggggtgtaagycaagagaaagacagttcaccaaatctatygattaatrgaaatcatccagcagcagtgccactgtaagatgttcaatacgtagcacctttctgtccctyctcctctwgccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaastgaacatctgtctaattgttcacctccatcgctttmgtgctttcctcatgctttctctctttccasacaataaactttattttcttcataagaattcagtctacgcaagggtattaggcagcttgtttgcaccttttaattsctggatgttttccagaaaggctgttwgcagtagttccagtgggttcatctgtgaatcaggaaagacaatgcagctttgtgttttkgtttttatcagttaccttctgtttgtaaacatctgtttggaaacgtttgctggtgcccaccccagcaccccyccacccctgccagaaataaagggattaatctctttttscttggcatagggagaagacagtgtctgctgatgtgcttaacttttttttttttttggtcaggtgygtaggtatgtgactgaaacccatagactttgcacatattgtcaaawgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcrtatgcttagraatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaayagagatgacagccaggggtggtggtgcatgcctataatcccaacacttttggaggccaaggtgaggagaccacctgaggtcaggaattyaagactactgggcaacatggtgaagctctstctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgkctgtatataaaaaaaagtatgtatacatayacgtatatgtatgtgtatagataaaaatgcrtgtatggtgctgggcgcagtggctcacgcytgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccsaagaattacttgatgaaacatggcagacracrtagaccagcagcaaactaccaacactgtggaggaycycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcmtgtayggaaaacaggagactttgtacagtggcctctctaaakgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgmttgaacccgggaggtggagcagtgagccaaggtcatgccactgcactccagcttgggcracagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggayagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgargcaggagaatttctkgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctaggttctgttgagacctgactttgggaatagcataggtacttayctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatytgtaaccttcctgcaacactgtctttgtgatgttatcataaccttgatttttgagggatagaattgggcataatcasagaaaacgtggtctgggacacatttgtgggctattctatgcyaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccrgtagcagagctgggattcaaactcagttaggctgacttctgtgcctgtttycttgcctaagcggtggacgcattgagtaggagaaggccagttattcctctttgtcactgatacaactggggacctgttgcyggagatgtggagctgtgcattagggctgggtagaacacacataatgaaccatatgcacgagaactttttcatctttctgcatacacttggaactagttctttgttwttgtaaaagcatcatgcacyaggtaaaatgtttaataacacagagaaatctaattgtcaagtatcttctcaacacacattaatcaacaattctcmtatcgaargataacctcttgtatttacaaaaaaaagaagaaaaagtgctgtcatcagtaaattcattcatgtatgttatacactyacatacaaaaygtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattakctgggtgtggtggcacatgcctgtaatcccagctactcaggaagctgaggactgagaatcgcttgaacctgggaagtggagtwtgcagtgagccgagatagttctactgcactccagcctgagcaacagagcaagactccgtgtcaaaaaataaataatatrtgtgtgtgtgtgtgtatgtacatgaattatatacaaatgagggaaaatatacaaatgagttgaatatatacaaatgagggaaaaattgttccttgtgtcaggaacaattactgtgaattttgtgtagctyttyctgactttttaaaattcaaatatatttcataaagttgaaatcacactgtggtctttttttttttttttttttttttaaccaracatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgyaaatagataatkcttgagaaagcttcttccytrtatatactctttctgyagcagtgtctgagtgtctgtaccttcctataccttcaccatatcatgtatttgtcattttatagtgagttgtattacttgctaggtgagctggtatctcctytgataacacaaagaaggcctgggtttgcttggcaatttgttccaatattsttttcagttttaaataagttttgaacaaaaagttttagcattttacataaaaacctctaaagctctcaggctaattagtaatgtagcatatacaaattaagtttttttctgctgtgcttaattcttattaacacactmatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctgggagaggtgactatggacttaattttgytttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggatacsaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcytgtcgcccaggctggagtgtaatggtgcgatatcggctccctgcaacctctgcctccygtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctcccccgtttatttctgattcaattactttatattagcgtagattcacaggtatttcctttttttttttttttttgatttattaatacctccatttattctgttgctgaaaccattccagctttttctggttggcttctatgaaggacgctattttaatggggtgatttttttcttctcactacattcttsctcactccccactttttatgtccggtggccataggctggtgagaacttkrttttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaaaaatacaaaaattaacaggcrtggtggcrggcatctgttgttccaggtactcgggaggctgaggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactartattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggcaatattcaagtcttcagttcyatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgyagtgcagtggcgcgatgacagcccactccagccccaaactcccaagctccagtgattttccttyctcagaccccaaagtagctgggaccacaggtgcacaccaccacttccagctgattatttaaaaaaaattttgtagtgacagtgtcttgctgtgyttcccaggctgtycttgwactcctgggctcaactgatcttcccagcttggcctcccaaagtgctgggaatacaggtgtgagccactgtcccaggccagttttaactcasaatgatttcataagaaatccacatctgagagtcccagaaggtaagatattcccctttcttctaaatatacttgaccaccaccattcaggttcttctattaaccytcctatatttgccaaccctcaacctgttagaaacaagaawtgggactctggagtagatgttagcaacatmatgagctcaaacccctccagcttacagcggagacagtgaggtcctstaggatgaggttggagagcaggaacttgcccgagrtcatgtgcagagttcgaggcagggcctggatgggaagcccagsatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacawggcattgtatcggttstgatttattaaccatttacttggctttggagaaggcagcatttttagtagtactrttgagcctgcatgtagcttttccaggagggcagggtgccyggatatctgatcttacagttattactttgtgtcrtatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgmtctttctctytctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacatkatcagtgtgattgtctccaacgcatcyatggaagtgaaaccgytggargaagctaatgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcmcctcctctrtggctccccccaccaaatttctgtgtcttcatttgcaactctcttttctccagtaaagaggaaagtgtatagttctcctttccttacagaaacattattttgttattgttgtttkggtttgggtttctgaagtataaatgcatatgaactggacagaagkattatgcccatgtgccaggtggccaagatggggcttgtgatttgaagcttcttttcctagattcaggaaagtatcactggttaatcagggaatacatctttcggcccattgkaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggttggattagtattttctttctacacatatagaaactgttcctatcatacstgactcagttttcaaactkgcttaatccaaagcctggggggtggatgtaggagagaagttgaaattagctggggttttttttttgtatcacaaaagttacattttttttttttttttttttttttaagacgtagtsttgctctgttgcccaggctggagtgcagtggtgtgatttcrgctcacagcaagctctgcctcccaggtttacgccattctcctgcctcagcytcctaagtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagtggtgcaatctcarctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttckgcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaamccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtrtgcactgacagaatggtacatcccaccactgctctgtgtctgtgtgcgactgtcagytgctctctactgctcctcatagacttcctgtctgcctttytctgcatttctcagtctccccatctccccttcttatctaayccccttccttcctctctcaactcttccttcctctatcctttttctttcccttttttttttaactattcttctttagagtttgttttctcattgaacttgtgatgtacacattaaaggaaaactcattaatgtggaaaattaggarcatcatagctaatgtatgctcagggcttactgtgtgctagacattattctgagtttacacagtgatgtcagatttctcctctgtcacagtaarttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcrgtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggcmgaggcgggaggatcacataagrccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagacagagcaagactgtctccaaaaaaaaaaaaaaaaaaaaaaagggcatggatctagatgccagacaatctgggtgcatatctttgctccaaaagcaaagattgtaaactstctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgttttytttttgattttttwatgtcattttaaatgtttctattcttctgttctgttcttaaagtatgcctgtaattattaggatataattawggattctgtcttatttattttttaatcttcttaytgtgtytatcttttgtctttctccatattctgggagaaacatctaagtttccattccttataactgattatttttcttgggatcaattctggtcttcaccatctgccaatgtgagttttagttyctctataaacttktaaactttaaactttttttcttttttttttgggggggggggcaatscattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatktcttttttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttawgttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtaygttgaaactgcctttgtgatctggstcatggttaacttcaataacgtatgaaaagaatccatatttttatgtgtagtgttctgtagctcttttagttggtttatactcttttaatggtctgttgaccattttatctaaatattccattttrtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtstccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttagggraattagcagctgtcagcccacttcctgctggtgcatggttgaggctcygtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgyaaaagcagcgtggagcagccagcacacaatgmcattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctaygctgtggaaagaggagaagtattctgagggacagctagttctatctgcagtgtatcttttttaaacagcatagaactattttttttttttaattctagtcttggtttctgcctytcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgwccttgtggtycgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcsgcctcccaaagtgctgggataacaggcgtgagcmactgcgcctgtctacattttctgtctttactggtattatggygggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattstgcataccaagcacatatccgtcacaygcagtgtggccaacttycgagaggccggcattcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagawacaatgagtaacatgtataggattttttttttttttttttgacggagtcttgctctgttgcccaggctcsagtgcagtggyrtgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagayattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagactyagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgccyaaaaaaaaggaaatccagggctttgctagggatcatttttggtgtggttctgtrttttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttccagtgaagatgcgatcacccattgccaccgttaccattrcttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttamattttctccttcagyggtaacacttctcttgtaaattctaactgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgcttttatgatcaataaayacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcstttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgartacatgaatttagtcctgtaaatgttttctcccttatttgggacwtggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccstatcrgtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagayccttccagtagctttcctgaagtcaagttgccagtgcattggacatactrggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgataytagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtagtagagtctgtatacataatttaaaatacattaacatttctgttttgcctgagataagcttgtactggtgtgatcagaaggaagaatgargatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaaggaaatgtgagcagaagcaacaccagtcactattaagtggaagtctttgagatgccacgtgtaactcaccacattgccttccacatgccgtagaggctggcagtgttacagacaacagaggctccatccacctggtccctgagtggccacggtgagctgggcccactgacctacaatgagtgtgaagtgtgagcaagtcataattctgggttattctaattaatggagatttgggggttgttccttactgaagcacatcctgattgatgcagaggatcttgtgagycatgctaaggaattcagcccacgtcttactgaccactctgacgtactaaagggttggttttgccaatgaagagagcaggctctgactgaacgaggcctgaacttttcatgttctagatggcatgtgctaattctaacacttcttaatgaaagtcatggtttgcttggtggtgatggaacagttctatgtcttgaatgtggtgatggttatatgaatacatacacatgataaaatgtcttagaattatgcacaaaggtacagcaaagaaaataaacgcatctcaagttgtgttagttccttctcacactgctatataaacatacctgagactgtgtaatttataaagaaagcaggtttaattggctcattgttctgtgttcatgttctgcttctggataggccttaggaaacttccaatcatggcgaagaggaagcaggcaaatcttagcaggagcaggaggacgaatagggggaggtgataygctcttgtaaacaagcagatcttaggcatactggatcacgagacagcactagggggatggcactaagctgtttttaaccagccccatgatccaatcacctcccaccaggccccacctccagtattggggattacaatttaatatgagatttgggtagggacacagagccaaaccacatcaggtgacatcccagtaatgactgtggtctagtaaattgtgttgtgttgatgttgattttcaggttttgccattgtattgtatgtatgtaagatgtatatatgggggaagctggatgatgggtatagggtgttctctgtaccagtttggccatgttttgtgaatctataattagtttcaaataaaagttaacaaccagaagatcaygagstaaaccaataaagtgaattatggtcmgttgcagattcactgccagacctgggaggaaatctcaccttggcagatsgagtctcttgtcctcgcctaacaatcagcagttcacctctcgaaaaggggttccgtttgcaatctgtcagccactaccttcttatttagagcatgtcccactacaaacatttctataaagttactaagtttgttagacaattagaattgcaaacccccaacacacacataaacacatatgcacaccctaatttaaaggctgcattttccatcccctggacttactgtattgcctccagtttctctccatttctcaggattggtagcagaaatgggaaacctgatacctagggcaagagaattgcctgaataacagtrtgtggacttgaatcactatccccaggagcctagtaacccacagcttgtggattagtctgttgaactacttgatggcttgtgacccctttttcccttagagktatatgttctgattttcttcttattgatagtggcagctctgtgctttattttgaagggaagcaggggaaccaaaagaaaacttagcagttgtaagttacttacagagaagactgggctagttggctgtgctatcatttttgttgaaatactgctttggggtcgccatctgggaatgytcttcctgttttatgggggaaatacatacatgcgtttttataatatgtagcctgcatatcccttggggtttccactgggggcttggctgagcagagcaatttctttaccaccccctccacagcataatgaatggctgcctttcctcttgtgatacattcacatttctgtaagattctgcacgtggcagtgagtgtcatgctccaagtaaaacgaggcagggaccagaggacttaggatgaggatgaaaggtcactttgtttgctgactctgaatgtcaggtagttgtgtttatgaggcatcagcgtctctgtggggtattgaaacatttacactttgaaaatatttttaatcatcagataaatatcagttactcagacagcttatgagggttctgctcctcatctggaggtacacacctttcacggggtgtgacttcaccacatgccttcaatattcttggtggcagttgccctctttataggggggatgtggcgtcaccttatagcagaccctctagctctgttatttcctgaacgtaggaaactaacaacccacgtgtgggcgttttccccttttcctagatcaggttcatgtttctcctcctcgttccaaaatctgcacactttggcatctgccactgttacccaagaccaggaatttaaatctgtgtttgccagtttgcctccaccactgatgtgctgttggggtttggggacataatttcatcactttctaccacctttccttaaaactaggcttygtgccaggtgcggtggctcacgcctgtaatcctagcactttcggaggccggggtgggtggatcmcaaggtcaagagattgagaccatcctggccaacatggtgaaaccccgtctgtactgaaaatacaaaaataagctgggtgtgttggcacgcacctgtagtcccagctagtcgggaggctgaggcaggagaatcgcttgagcccaggaagtggaggttgcagtgagccaagatggtgccactgcacttcagcctgggcgacagagtgagactccatctaaacacacacacacacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagstgcaattacgctgaacrtctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttggsttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgytaggcgggaacttgggcttctttatcagtgactggggtcagttcttgtactcaayttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagcsctgttcttccattcattccgatgatttatattctctctgggcrtcttatattaaacaggggaattccgacatgttccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacrttagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgygggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgccwgtaatcccagcagtttgggaggccaaggcggggagggtcatgaggtcaagagatcaagaccatcctggscaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaagtttgtactcagcctggcgtggtggctcacgcctgtaatcccagcmctttgtgagsccgaggkgggcggatcacctgaagtcaggagttcgagaccagcctgggcaacaaggtaaaaccccgtctctactaaaaatgcaaaattaactgggcggggaggcacatgcctgaaatcccaactacttgggaggctgaggcaggagaatggcttgaacccgggaggtggaggttgcagtgagctgagactgaaccagtgcactccagcccgggtgacaagagcaaaactctgtctcaaaaaaaaaaaaaaaaaattgactcaggctcttgctggagtatgycagtgtcccaagtcaytgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccaccsgttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtaygttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcawtgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcrtgagccaccctgccygaccctttcattttaamtgtgatagaracagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgygatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctktagtttgttataagagtcctgcacacttaaccatgattatccctactttgcaaattacaaggttgcagtgcagagagcctaagacactttctcaacttgagcaagtaggagatccasaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacrtaaaacaagaaacatttctkttgtgcctcctcttttcctccctccctctttctcatagttaatttgtttgaatcaggattcaaataaggtckatgcatttttaatctataggttttgtctcctttttttttttttccttaaaaaaatttcttttaatgcaacagatttaagggaccagggtgttctctagagcaggggtccatgacctctaggccacaaaccaatagcrgagccgtggcctgttataaattgggtggcatggcagggagtgagtggtgggcaagyataggaagctgcrtctgtgcttagagccgctctctgtcactctcattastgcctcaggtcctccccctgtcagatcagcaacagcattagtctcataggaccgtgatccctattgtgagccacacatgcaagggatctaggctgcatgctccttasgaaaatctaatgcctgatgatctgtcactgcctcccatcaccttcaagatgggatygtctagttstaggaaaacaagctcagggctcccaccgattgtacattatggtgagttggataactatttcattatatattacaacgtaataataatagaaataaagtgcacaataaatgtcatstgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcggtagcagcggtcgtyggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctrtattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaargttaaaatracggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaayatgagaaatccatttttggtttgcctaacagaagatcatsttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttragaattttcagactattaagwtctctgttgcaactgcttgcttttgccgtggtagcctgaaagcagccrtagatagtatggaaatggatgatcatggcagtgttgcaataaaactttacaaaacagacaatgggccagattggccaggggccatagtatgctacccctgggcaacaamctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttttttgttttgttttttctttttctttttcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtayagcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttctttcttacagtagttgtgatgcttagcagttttttgataactttttatratgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatmctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctctyatcagccagacagtctctgcggcaaccattcaagcattgttgaatacattgttgagtgttacatgagaytattgtaatataaaagtagcctgggacaacacataaataactgggtgtggctgtgtcctaataaaactttatttacaaagaacaggaagtggcttggatttggtatctggcctggcagctgtggtttactactccttrgacggtggcccagagaccctttaaatgaaattcaktttactagcaccctttttcatcatgagaaatatattctgtttttcttaraaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatyatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgyatagtagcttggagaatcagaaagatctrtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacytcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggccsacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttyggggatgcttttttctrtattgattttacttcattaaactgagctccagaggagcagaaactttggctaatacatcttggtcttagcttgtaatatctgtgctacaacttattaagatggtgaygctggcaaattccttaatctttctaattcttaatttcatcagcaaagatgggaaaggatactaacacmactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggayggaaggggtggaaggggatgcaagaggtaagtacaaggaaggggatgggtggctggctggctagatggatagaaggttggaagasaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaarkaatcatagttgtatgtaatcgtarktacaacaatarttattttaggcacataacccaaaggttttmttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatayamgacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagrttatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatyaacactacaattcatatatcagaatagcactttgttacttgtttctgagatagggctggctctgtcacccagactggwgtgcagtggcacgatcacagctcactatggcctcagccaccagggttcaagtgatccttccactcagcctcctgagtagttgggactacatgcstgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtrcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgwgcgccaccacgcttggctaatttttgtatttttagtagacacggggtttcaccatgttrgttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttmatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttstcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcrcattccccaaacaatttttttcttattgtttgtaagttgtaagttgtaarttcacctctgccaccacctattaaagcccactccctgcattaaaactgtataaagtgtatttaaataaactctctttgcatgatgtgaatgaaatcgtcatctggtamttaaaactattctataaagttattaaaaaattaatgttcccttcccatgatttttctgcagaatttatgcatccatgatactgcagaagttcataaataatggcttgtattgcygctttagtattgctttatgcctacraaatataatgttaatttgtagcaatgctaatgtgttttcaggaaggctctttgtttattgcctttattttccccacttascaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgyatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactatragaagttgcaaatggtgcatgaaatgaaaaattcctggtggtctccaggggacacagccggtgctgtgctscactctgggtaactgttttggattattttctctattcyaactgaaataaaaaaaaattaattaaatgtggctaggttatcttgacagcagaatccattsccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttscttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatyctcttttaggcaccatctctgtcaaggctgatgctgggctttttatatattttctctaattcttgtggctgtcaaacaaggtgggcattatcattscctttataggggacacagctgtggctcagaggggtttattcactttcctgagggccacacacataatgagaggcagacacaggtgasgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtsttgstttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatayaaatatawatatatatatatatatatatatatatatatatatatawatwtatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcascatgttggcgaggatggtctcagtctcctgacctcgtgatccgcctgccttggccttccaaagtgctgggatatacattttttttttttttttgagagatggagygtcactctgttgccgaggctggagtgtagtggcgcartctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtkatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaraaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagcyggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatsacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagatraaragcaagggaagaattcctggagaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattgrtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcrgtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaayagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcsgagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccasaagtgagggaggagcaggatcctctgcaacagggcagtctagtcttagcagagaggaggttgctgratttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaaccsaggaggaggagattgcagtgagccarttgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctactccataggcagagcagcaactttggctgttggactaaggatatttatagttaattattgattagctataatatattttaatataatatatataattataatacaatattatatataatatatattttatgtaactataaacaaggggtagattactcatgagttttcacggaaaggggtaggcagttccyggaagtgagggttcttcccctttttagaccatatagggtaacttcttgatgttgccatggcatgtgtacactgtcatggtgctggtgggagtgtctcttagcgtgctaatggattcatattagggtataatgagtagtaaggatgaccaaatgtcgttgccatctttsttttggtgggttttggccggcttctttactgcaacctattttatcagcaaggtctttatgacctgtatcttgtgctgacctcctatgttatcctgtaacttagaatgcctgacctcgtgggaatgcagcccagtaggtctcaatsttattttacccagcccctattcaaaatggagtcactctggtttgaatgcttctgacaaacctctgagactaaggacaagatggagtctgttaggttagttttaatttcctcagttattatttcacaaagggggtttcagaaagatagaaaatgctagaaagagacggggtagtcagtggtagggatcttgaggggttaaaaaagggaaggagctggtccctttgcagtaggaagtgccacctcactccactcttgccagaaagcctggctctgtcataaggaatcttggcccattgtcactctcattgatgacaacscccgcccccaccactaccaccttaactactgaggggatgtcctctggcycagaaggaatgcattggctctagttgaaggggttgctggtttgtaaatagcatccccacagtcagcagacacagagaatgccatggggccactcatcagaaaggtggaggggctttatctgtgggtagatgagagccatgtagaacctgcatgctgccttccattggaatctcaggctctaaacaaggaggacaaccttttctgcccttaatcacctctcacagatgagaatccacccaagaagaagaaaaaaaatcagccccttaaaatgctgactagtaacatcagttyttggaaggatactatttttgtttccattctgtctttatagtttgaacttttccttttsatagtctgtaaatattcatcatctcagagccttttgaattgcaatggcttttagtcaaaactgagcrcaatgtgccatttgaataataagaacctcattaaagtgaggcaaaagtaattcttttccttttgtacaagccaattaagtgtctttacaattaaaacaaagtcaagcactttatagtttcatattccacaagcctgtttttaattaatagaggtgacaagttttaggtacaggatacatattttgcctctggagttgtgcaattaacattaatgaagggtattaaaatttggtgagagaggaaagggttttcccaggtcctctgtgggttcttgcctccaggcctgtctttggtagcaagttccttggtttgctgaggtttgcattttcttgagagaatgtacaggcaagaataaaagtaactagaagagacattgttgttattgagaagtatgaagttaaaattcccaatgtccaggmctgtcttaaaattaggtaaacactgcagaaactatctttgaggaatttaattttgtcttgtggataaaagtgaaggataaagaggagaaataacaattatctaagctggcaggccagcaagatactggggctttacttctcacaaccatgggaggagtatatttagtttacaggggaggacacagattcacaggggtgaactaactggccatgagtcaggtaaggaaaataacatggctgagctacagtttctctaagaagttggttctgtccattycagggagcttatgtaagacagaaggtattgtgcagtagccttgaagtcaggtgaccctttgggggtgtgtgtgtgtttgcttctttatattagcttttttttcattttragacagggtgttgctcttcctcagttgcccaggctggagatcagtggggtgattacagctcactgcagccacaacctcccaggttcaagagatcctcccacctcagcttcccaagtagctgagactacaggtgcatgccactggctatttttatttttttctttttagttttgagtttttaattttttgtagagatgaggtcttgctatgttgtccaggttggtcttgaacccctgagtccaaaagatgctgctgtcttggcctcccacygtgctgagattacaggcatgagccaccatatctggcctatgttagctatttctgaaacttcatttctgtctgtaaatggcaatcataatatatgtcacgtagggttcttaaatacaaaaagctcttaaaaagtgcctaacccatagttagtactcaaaaaaggaaaaaaaagtattaatagccctggaaaagtgagcaaaatatttcagatgcaacctgaaaggagttcaaatgtaagtctctcttcactttgcccatctttccctcttccccgcaaggtttttagcagtggtcctgtcttactacaatatatgaattatccctgctacaaattagtagattctgctttgatttgaagcagagtctaatgagtgttacaggtaggctcggtgcttcaaaggatttctgcctatctcttcacagagtagctgggctattgagggactgtgtattgacaattgtagtgggcaccctatgtggaaaacaggtgttgtcaaataactgcaactgaccccaaccacaccatgacttttcaggttttaggtaggggatgggtgggaaaacagatgaggcaacagaatgaattattccttaataagatccagattaccgagtgataataagatttgcatgaatacttcaaacaacaacagtgattaaatacgtttttctagttaaaaaattaatgagtgctttccagcaagcgcttaaagaattaatactggccgggaacggtggctcacgcctgtaatcccaacactttgggaggctgaggtgggtggatcacgaggtcaggaggtcaagaccatcctggctaacatggtgaaaccccgtctctactaaaaatacaaaaacaagattagtggggcgtggtggcgggcacctgtaggcccagctacttgggaggctgaggcaggagaatggcgtgaacccgggaggtggagcttgcagtgagccgagattgcaccactgcactccagcctgggcaggagacagagtaagactccatctcagaaaaaaaaaaaaagaattaataycaattttccacaaactcttttaaaaaaacagaagaggaggaaacactttccatctgacwctgtgaagccactattactctgacaacagaggcagacaaagatatcacaagaaaaggaaactttaggtcactttcacttataaatagagatgcaacaattttgtacaaaatgctagcaagccaaatgcagccacatatacaaagaattgtatattatgactaagtggaatttatccaaacaattcacggttggttttatattaaaaaatcagtcaatataatataacataatagtagaataaaagatcctctcaatacatacataaaaacatgttttaaaaaggtccagcacgctttcttgatgaaaacttttagtaaacttggaacaaagtggcattttctcaactcaataaagggcatctgcaaaaaacccacaaatgacatcataattaatgctgaaagattgagtaccgtccccttaggatcaagaaataagacaaggatattcactctcatcactttaatattctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatnnnnnnnnnnnnnnnnnnnntatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagamcttttacaattcaataatgaaaactcatttaaaaaatgagcataaratctaaatagatattcctccaaatatgatacacaaattgccaatgaatacataaaagatgttcaatctcattagggaaatgcaaatgaaagccacaatgagattccacttattgmtaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtrgatagagggtggctagtgattgctaatttttttttttttttttgagttaaaaaagtgctataawattagaatgtagttatggttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccactyctctgttgttggatgttagattgcttctagttcatatgtaattttataattttagttgacrtgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccryccttggaatttcttggcttttatcttagtcagtctaatctctgcctctgtctttccatctccttctctgtgggtgttccttctccccttctgttttgtaaggataggcctgtcaytggatttaaggcccaccttaatccaagatgatctcattttaagatgtgggacttamtcacayttgcgaagaccctttttccaaataaggtcgcattcacagatccctaccattcaactcactatggaagsaatgggrtgggaggtaccattcaactcacagattcctaccattcaacccactataaagyagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttytgctgcccctgctayrtacatgctttattgcttggaaacaggattacttggtgaaataatgtgaatctttcaattctcatgatacatgttttcamcttaatatccagggtgcaggaatatatattcccaycaactttatacaagataatacaaatataatagtatgaataaatatgctaatttgatagaaaatattttaatatttactastagtgtagttggacgtgttaaatattgcartggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttgaactcctgggctcaagtaatcctcctatctcagcctccgaagtagctgggactacagccacacaccaccacacctggctcactttcgggtggttgttgttgagatggggtcttgctgtgttgctcaggctggttttgaatactgggctcaagtgattatcctgccttagcctcccaaagtgctggaatttcagaggtgagccactgtgcccagcctcctgttttttttacatrtatatatatatatatatatatatatatatatatatatatatatatacacacacacacacacacatatatatatacacacacacatatatatatacacacacatatatatacacatatatacacatatatatacacacatatatatatacacacacacatatatatayacacacatatatatacacacacatatatatatatacatatacacacacacacacacacacacacacacacacacatatattttttttttcttttagatggagtgtctctctrttgcccaggctggggtgcagtgacatgatctctgctcactacaacctctgcctcctgggttcaagtgattctcctgccttagcctcccaagtagctgggattacaggcgtgtgccaccacgctgggctaacttttgtatttttagtagagatgggggtttcaccatgttggtcaggctggtcttgaacttctgacctcgtgatttgcctgcctcagcctcccaaagtgctgagattacaggcgtgagccgccatgccygcccttatttttatatatcttccataacctttctatctctttctttctctttctctgtttctgtgtgtgtctgtgtctgataataaaatacattaaattttattttataacataaatgttttataaggtcggtagatttgtttatgattttaatggctgcatagtattctatcatatggatatattctaaatgtaataattcctcaatggtatatttagtttactttwwatttgctgctttagtttgtcacaaacacygtggatagccttgtatatatttattttgttgtatagttcttattggtacagtatgatttttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaattaaatatatacaaaataagggagaatactatgacaggcttccacttacctatctttaggcttctttataaaatgttcatttaatctgatctctataagaaattctgtatccttaaacaacatgtgccyttctctttasacagagcgattacccccttgctatgttttattagcagctagcaagtgctgnnnnnnnnnnnnnnnnnnnnataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagrgtatcctatttctacatggtgggaatctagaaracggagaaagaatttctcattcccgaaggagcatggattatccttggttgtagtgtttatgtccacatcacgtggattcccraaggagcatggattatccttggttgtagtgtttatgtccacatcacatggratattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgattgtgggggactgtttagaaggactttctagagcaasgaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattrgagcctgcgagatgaaatcmaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaargacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagyaaagtagctagaaaaaaaaataacgtgcaaggggcctattttttcctccttcttctccgtcttaagtcctgaaatgttttagtgacccagaatgaagcttatttttttaatcatacttccataaaatgtaacycctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtstgatggctggcactggttttatgctttccaattattctttgcacatcgttatttattattaytrttattattatttgacatggagtcttgatctgttaccaggctgcagtgcagtggcatgatctcggctcaccacaacytcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttcycamagtgctgtgattacaggcgtgagccaccacgcccggcctctttgcacattatttaagggtgttttaacaaaatggcaatttccccaggctggcttgtgtattaccttygcattgcatcccttggctcccatgagtgagcgtggtgacttggtgygtaggtggtacgtgaagacasttgstcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagrcataattgtttggctttgtcagtttgtcaacttgaaaatagagtcagcagcatctraagagttgttttactacctctggagctgagasgtgaacatagtcgtttttcaggaagccgtttctggctcagacagatmagaagctggcccacccttgccacttcctggaggactgtcagtgctagctaatgagactgtaaaagtggactatctgcccaggagacagygaggaaggaaatcaggggtcacccttayagsgaagggctctttgcagagagagtgcctgatacrtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaarcagggaccttattcttaacagtagaaaatcactgtgtatgatgatartgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatrcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacmgaaggatggcacagtgagccttttcaccaatcttggaaggccagtaatgtcagtgaacactaggaatggtgtcatggcctgggtcctgaagagtggatacttaatgtmcatgraggcatgyatttttatctgccttgcatggcttctttcattctctccctgacttccacccaaaaaatcaccrtgatatccagctgtggaagagttcattatggagagcttcctggaagaagtagtccctgaactgggttgggctaaacaaayatgccaagaagggtttctggaagcagttgacaaaagatgagtagagagagggagggggtggtgctatatttattccatacctttcagatactctctaaatccttgtccctgttktctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatakgatagctttactgtaatgaaagaaaaaataactgaaacaaaatggcgtgtgtttcaacatgtaaatgcttgggccaggctrcaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagrgcaaagggatgtsttacatgacatcaggcaacagagtatgtgcaggggaattctcatttataaaaccatcagatttcgtgagacttattcactaccatgagaacagtatgggagaaagcrcccccatgattcacttatctccacctggctctgcccttgacacatgggggttattacarttcagtgtgagatttgggtggggacacagccraaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattscttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagaytttgccagaactcatcttggctttgtttacatttttcttttaaacgtataagactattgatggtacctcaccaaggttataacccctttataatcattaatttttaatctagaaaagagtcttggrgacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatayatgttagagggtggggagagagttcagtatgtcaggactgctacatttatgagtgtgggtctttattgaagtctctctttgtagccaatccttttttttttttttwatttttaaattttaaattcttacttttagatatgggggtctcactctgttgcccaggstagagttcagtggcacaatcatagctcactgcaaygttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaagkagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccracctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaastggacttcagtygcctctctscaacaaaaaacgactattgggcgatgctggcttataacaggtcsaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcytagagaaacctgcamacttgtgtstccacctttttacctcttgcgggcatgagtctggtctcagtaatmacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaawctgtatctkwtgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatgsttttagtaggaagtaytttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaayagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcrcaggcattcacttttctttcataaacatttaggactctgtatttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttayacatttctaattgttgctgtaaatgcattatcactttgaaattaattaatttttccattttggctgcctgcaatataataatcaytaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcayatcatacgtgcattacatgtttattttcttgactctagagcattcttttatgcagttaaattactctaaaatgttttgcacctgcacgcattaatgtgtattgtttggtaagaacttycgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtgraccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcrgctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagygaccaatggatgtaagtaagttggaaaaggrcaaaggatttagaatcatgagggttgtattcaaactgcagcctctrctcccttttagttacataattttgaaatcatttgacatttctgaggttaattttctacatcagtttagctgctttaggccgcaagttattaacacccacttaaaggtgkytgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaagkagactagaaaagtgcataactggctttttgagcctctagagtggcaggcgaactctgattttgaggaaaaaggatagggtaatggtgttgacacaggcactgttgaatacgtatgtacrtattttaatagtttkctcattaatcaaatgkaaatgctatcgattttataggrtcgttgtgagaagaagtgagaattgaaatgaaaggcatctagtcttccccggtccccatccacttgacccaccatacctcaagccacttctggctccatgctctktctttccttagggttttgaaacatgttcttcagcctagaatactsctcctccactcttaatttctacccatcctgcaaaactcagtctgaacagcacacgtcaaggaagcagttttggtctctcagrttayatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggmcaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtktsttatttaatgtctgtccccccttctcttgacagtggtgtttttgccttcacactactgtatccctggtccatacmgtaaatkttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcsgtcaacttacatagctatcattttttgtgtgtggcaagaacattgaaagtctagtctcagcaattttcaagtatataatacrttattattattactatcgttaactgtattcaccatgctgtacaatagatctccagaatgtattcattctgtctaactgaaacttaggatcctttgaccactatctccccatttatcaccccctcccacttccccactaccagccyctcctgggaactgccctctactctctgcttctgtgagtttgactgctttaaattccacacaaaaagtgagatcatagagtatttgtctttctgcgcctggcwtattttacgataaattgattgcttctcttyccattgtttatagatacccattctcgtaatgatggcactgtgtctgtcatagaaggcctaattctccctgttaacattgaacatraaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatamaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacwtgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaarataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtsgagtctcaytctgtcaccaggctagagtgcagtggggcgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgamtggcctagaaaaccctacaggtaccatttaagctccatagttcttctgtgtgtgtttcggatcccaggttccaaacctgcactaaaacttgttgctgcatctcacctaatcgtgtagtgagccaggtgagctcatctgtgaaatgcagacctttctggacgtaccacctcgtgkggtgaagggaaagaaatgatacaggtgtacatcagggtataagctgtcctagagtctrgattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccrggtgctttgctaggkacagaakgctrtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaatasgcaaacaggtttacaggctgaggtgggctggatcacttgaggccgggagtttgaaaccagcctagctaacacggtgaaacccttctctactaaaaatacaaaaatattatctgggygtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctccttctgtctcccaggctggaatgcagtggcattwtctcggctcactgcagcctccgcctcccaagttcaagccattctccartctcagcctcctcagtrgctgggattacaggcatgtgctactacmcccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatkcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgrggaagttaaaatatagactttgttgttgktgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcytggcgctggtgagggggctgtttagcatggaaataggattataatgacacctgaggtctttttgaagtccttgggtcrgctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgttaaaaatgtataataaagtatctaatttagcaaaattcaratttcccctatgaaatatcaagctctttttatgcttcttcacatgscaccttgtgtagaatttgaaccactttaaacattgcatccttgagttgcatatgatgggatmtcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatwtttgccggatccaaaaaaaatactgtgtatsaactmctgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctatmaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggycatattaatgsaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagatttkttcaatttttttttactgtcatatgattcacatgctagttactgattgctatcatgcagtctgccagcagaccagatggcagatcttytaattagatatgtttgtgtgtgtatgcatgtgtgtgtacatgtaatcacagttcatcaaggacctaataaatacttttttctctctctctctttttttttttttttttttgagacggagtctyattctgttgcccaggctggagtgcartggcggatsttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccraagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagtttggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacayctggtttttgttgtcattgagtttttgtgatggggtgatttcartgrgaaatatatgccattaatttgatgaaaaatcartatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttkctctaaaacagcatctctcaaacttttttggaccactatctaagttttttctgttamaacccaatacatttatacttatgtatattcktgtgtgtgtgtgtgtgtgtattatatgcatgtgtgtgtatttgtckgaaataaaagttttacaaaatgwtacttttatctgagcagtgtcctgctgttttttttcccctaggttgtgtttttgtgtttttgtttgtttgtttgtttctttgtttgtttttgagacagaatttcacttttgttgcccaggctgsagtgcaatggcacgatctctgctgaccccaagctccgcttcccaggatcaagcgattctcctgcctcagcctcytgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggasgcmaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggygtggtggctcatgcctgtgatyccagcattttgggaggccaaggtggacggatcaccagagttcaggagttygagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatgatgcctsggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgarattcaraggttgtttttatagcagcaacacagtaagttgggaagagggacacatttttaacatagacaccaaaagagaggctggaaragttgaccacttaraaatgtcacgagtgtctgtgaatagtgttgggggmtgagaggcaaragaaraaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctytttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatygccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgycgaacttgccctacatactgttttattatatattctgcccacttctattccctgccaattaattaattgtttcattggtatagtttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggattacaggtacaagccaccatgycaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaatkagcaygtagaggttggcaaaggggacaggagactgtgggatgattagtatattcttatttggcctgggagggaaaaaaartctttcatttccaasaatattcwttctctgtgtcacctcagcatttaatttacttccrtcacaaaactacttgaagttgtcccaggctagttggtcctattaattacaacctagagggattctattartaaactaatggattacagtayctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcaccyaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcastatctgggctcactgcaacctgtgcctcccggattcaagagattcttgtgcctcagccttccaagtagctggttttgcaggcatgcaccaccacacccagctagtttttctatttttagtagagrcggagtttcaccawgttggccaggttgttctcaractactgacctctcctcggccttgcaaagtgctgggattataggtaccccgcctggctgatactttccttagttgttttcagtgtaataacctgtcttcagtctactytwtgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatggratccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataattytgaagaaataggccctccagatatcrgtagtgacagggstatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatyctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagyggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacraggcagcgggcactggggcagccacayagacaacatcyaaatttttgttgctttcctgggtcttgccctgtccttactgtttcccttgggcacgctgttcaccccttaggacatastacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacagrcagcactgaggaattatacacttgagcttggcatttttcttaacgcagggctattttaggtgcastgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctcmttttctagtatggacctttggggctcaggatgaggatgttcamtttgtactgctggtggagctgcctttccattaagtgagtctttctccaagggaacagaagtcttaggttgttgatctggckgtcagaacctaggacaggcaaggcagtgggctgttgtagagkagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaagkawagagaggaragaggggaagggaggaaggaaagaagagakagaaggaggaagagaggraagkaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacrttgcccccacccrtgcagcaattcttcctgggaggcctcattgttcatattcataaagggccccattcagtctccyttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagcagacmagaaagygtgtgcaggggaactgccctttataaaatcaccagatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataycttttcattagtractcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttyatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtakggaaagcctgttaatgagtacawgtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatckygttacccaggatggtctcgatctcctgaccttktgatcagcctgccttggcctcccaaagtgctgggattacaggcgtgagccattgcacccggctattgggtacaagtttcctttggggtggtgaaactgttttggaactagaggtgatagctctacaacactgtcartgtactaaatgacactaaattgtacactttgaaataatttatgttatgtgaatttcatctcagcaaaaagaggctaacacataaggagacatattttgatacatgtggcatattaagctgctgytgttgttttttaaatattcmagctgcgtgcagtggctcacacctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttrggaggcygagrcaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacwcagtctrtatatacwtgtatgcgcacatacacatattttaaggaragaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatayttcatacaaagctatgaagcatattggaagattttaggtgccctgtcttcctggatataaaatgactccaaactcagtgatactgatcrscctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacaytttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaacccmacgtattgttgcaacggcaaaaaagagaattgcacagaggaacaccacctatcagagttcacactgagtttgcagattcatccttttgcttccagccatcccatggaatgcygttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctasgttactgcacctgtttgagcctcagttttcctgtctgcaaaggagggatgatggtacttacctcaaagaattgtagttggatcaaatgagttggartgggatacagcaacaatctatattctgatttcagcaacactgtgcagtgtaattccatattatattayaccacatcttctgtgggtctttctttgrgggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcavactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgygcagatagtggggaatagtctatggattctgcttacaccatggacarccaggctgggccatgggttgtgttttttttcctctcattttatagaaatgttaccaggcatattttccctgtttccctaagaagagcttcctstcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatrtaagatccataatgactcttgcyaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcytcacctgatgtattgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcstcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgatygaccyacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctgstattttcactcttccttcctaccctggatgctgatttgatgcttccagccttagcggtyttcttgcttctaggactgaacagggaagagggaawagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagygaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcrcagtggctcacgcctgtaatcccagcactttggaaggccaaggmgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaarrwttatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaatttkaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagataytttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccsctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataagktgttggtttgttataaggtggtcctttataaagtttagacctattttaataaggctgacttgggttgaagataactagagccatgacttycatcttgatggacaatgagtactcactctacttttttaktttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtrccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtsgatgaagctggaaaccatcattctcagcaaactgtygcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatamatgataaatacaagtagtagcatttttagtaaaggctgttayaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatattyaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattmttccaggccacaagggkgccgttgagttastggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcayagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtsaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatrtaaattaattaaaattaaaagttcarttgctctgaaatagcagccacatttcaaatcttcwgtagccagatgtggttattggctaccwtattgggtagcaccgatatagaacatttctaccatagtagaatgctcttttggatasatctgctttaaagcattagtccccaaagtgtgaaggatgaaccamttgggttccgagagraaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcmtcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatcaactgggtgttaaaaagctggtaagtggcasagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatkcatgagtgtgttagactgcttttcttctattttttaaaaatgcacccaaatgtaaaagayacttttacstttttgatttgatgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcamaagatactaattcwttttttcaaatgcagcatcgcttgaagctgtgataaaatatcacacctttggaaatcaaggctcttctkgtttatttatttaactcacattaattagccttaatttwaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaagrcacgctctgctctgccctgmcttcygatgagctgactaacaccttatagatgargttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttmttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagttrgaaagagatgygtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttsaaacagtctcactctgtcgcccaggctggagtgtagtggtgtgatctcygctcactgcagcctctgcctcctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtttagaggaagctcttyatcctggtacsctrgaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtrtctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatggaaatggctgtggggcgcctgagstgggccctggcatgatggcaagwkgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaaygatttgttcagattggggaaaaaawttttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactggcagtgagctcatatggaagargcatcacgggcaactcggcttggctcaccagcycctgagctgcccccgagtgaccgctccagmcttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtyagctsctacaccatgagtgcttttgtatsgtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcargattctgcagcccagggtgctgcttgttgatggacatcttcacctgactttctccctggtccaggtgcattttaagcatggaaggtgacacttgccrttctcaatggacaaagggagtggggagtgtgggggtgtgctttggrgttagtctctgggttttcgaaacttagcattctcagattcccagscaactggtttcacatgacaagtaaatgagcaacctggaagatgagtggcgtttccacacacagggaagcagatagttccattasgtgacagtgtgtgcacagtttatggaggatgaagcrgraaacctgagccacaakgcagtakaggttggacgagrcactcattccgaaggsgggtgtgtatgtgcaaactgtataatttttttcttsttttctatctgctagcaaagtggrtaagttgacccatgacatsgtccactggagggaccacatttgtgactctagcaattaagcytcccttctcatctgtggataaaactgacctcccagtgtgctggagtcaaacatattcagcatccaatccacattggactgtttgcatgtaacgtacagaacactcattcatctacatctaggaccataacagygagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatrattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtytggtgatttactgctgttggagcctggmcttcttcctgggagaaggctsgaaaaacttcawgtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacaggcttacccagttcatttaggcgtggctygattwatgcacacaaagctttgggaacatatcagtcacatcaagctaggtccacctgtgtgagtaastaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgaraataatgagctaatatgtatctagtamttgctatgcacttatatgtatagaagcgtataatccacagcactccttctgaatacgttacgtaaatggaaccctcgcaacagtcttayccccattgtagagatgagaaaactgaggcatacagaagrgatggaactaggccaagagcatagaggtggaattgttgtgtgagcctgtagagtccgtgttcttacccactgcatgatgtctgatcatcgtcaattttctttccatttggayagatgaatggtaayacttccctactaggtagagcaatgattccagaagtttataataattggaaagtgtattagtcgattctcacactgctataaagacattcctgagactgggmaatttataaagaaggraggttyagttggctcgtggttctgcagactgtataggcttctgcctctcgggaggcctcaggaaacttacagttatggcagaaggtgaaggggaagcaggtaatgtcttcacatggctggcastggaggaagagagaaagtagggaggtgstagatgcttttaaacaaacagatctcaggagaactctttcacaagacagcactagggggatggtgattagaaagcacctcatgatcccgtctasttcctgcagagaacagaytagccccctatgcagcacacacctttgtgaggtccctyctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctcccccmatctktatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaaccyagytcaccgccatcagatgartggaggtttcttatgctgtggcgaaacccagggggtcaagcccctcggacatgacgtactgcaaagtgaggatgtttcattgatttrtatttttaaaattaaaaataattatttaagctgcatctgtgtgcttataagaaaagatatagaaagattagtagtagactgttgtgttctttttttttttttttttttttttgagatagactcttgcctgtcgcccaggytgcagtgcggtggcatgatctcggctcactgcaacttttgcctcctagattcaagcgattstcctgcctcagccttctgagtagctgggattacaggcgcccgccaccacacccagctaatttttgtatttttagtatakacggggtttcaccatgttrgccaggctggtctcgaactcttgacctcaggtgatctgccckccttggcctcccaaagtgctgggattayaggcgtgagccactgcacctggccagtagtagacttttgatagggtttttttttctcaaggtgtagrtttggctaggaagtcatagaaaatgstctttttttttttttggagatggagtctcactttgtcacctaggctggagtgcagtggtgtgatctcagctcactgcaacctccatctcctgggttcaagtgactctcttgcctcaacctcccgagtagctgggactacaggccaacgccacggcacctggctaatttttgtatttttagtagagccggggtttcaccatgttggccagggtggtctygaactcctgacctcaaatgattccctgcctccacctcccaaagtgctgggattataggtgtgggccactgtgcccggccaggaagatggtcatgttttactttgaascaatctgtgcttggtttatttttttcagtgagtgtggattacgtttataattttcrgttactagttaggtaaagaatmaaaattaataaacacatttatagttctcagagattccttgagagaggaacatctttaaayggataaccacagtcttctaaacacctgaaagggtgtcttttgctgaaytatggagttttagttttgctttagaatttttggatgattagacttgtacttcttttaggctatttttccacctggtactatttggctttactgamtgccctcattccccatacaccaccttgttttgttcagattcccctaartcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatgggaagtgcattgaggaagaggccccaagacawggagaagtcactccaactttccggraacmccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaayttctktacagaaaggaagcaatgaacagagtgaagcagcatcctacagaaagagagagaatatttgcaaaccacacatgtgataagggrttaatattcaaaatgtacacacagcgtaaatgcaagaaaagaatctgatgtaaaaatggcccttccaacatctagcattattgtgtgttgaataaatacttgttygattaggtctaatcactcttcatgattggatttccaaaatgtggactctcagcagkacattacagggacagtggttgggtctggagatgtcacccttagctgtttttcacaatgagaggttgttttatcataaataaatcaataaatggyagatkatacaccgkagttactgagaawtataaaaaaaaaaaaagcccacattttaaagggaatttggtatttttaacaaagcatcagggggcygggagcagtagctcacgcctgtaatgmcagcactttgggaggccgaggygggcggatcacaagatcgggagatcgagaccatyctggctaacatggtgaaatgctgtctctactaaaaatacaaaaagaaattagctgtgcgtggtggcgggcgcctgtagtcccagctactygggaggctgaggcaggagaatggcatgaacaygggaggtggagcttgcagtgagccgagattgtgccactgcactccagcctgggcaacagagcaagactccatctcaaaaaaaaaaaaaaaaagaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagacygagaaagkgctgcacacctttggcctaaagggtaatgagcaacacacaaggattgggagatgttcatggcaagaaaaattcasaagggacattgttgtttcactaattctgtaaaggagagcagcggcatttacttakgccgattccccattctctctttctgtttttaaacagagacagatcytgctctgttgcccaggctggagtgcagtggcatgatggcatgatcatagttcactataatctcgaactcctggtttcaagtartcttcctgccttggsctcccaaaatgctaggaatacaggcaggagccactgttactggtctgttttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctmagtggtcaggtgggactcatggagattttccgttctttggmractagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcamagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttctyccttcctccttttcttctttctttcyttccttccttcctttytcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcrttttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagasagcatgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgttwcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctttctctttttttttyttttttgaaaaacttttttggagcagcacctgcatgttgtaaaaacacaaaataaaaaaaaaataaataaaagcagaccccttggttcagatatctttgtttgtgwaaatgttttggcattctttrtgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcaccatgttggccaggctggtctcgaactcctgacctgaagtgatccacccacstcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtgcctaccatataattcatctgctyaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccartatcstttgatgacatgtcttggcagtgatgtctatgacactgggcaagtgtcttaaaatgttgtgcatcagaaaaaagtcatcattgccaaggccagcagatctcgaaaagggggctgggayacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttrtcagaggtgcatgctgagagcatgatgggaagatggagtcttccatccrctggtaaaatctggaatctgctctcatttcattttcactgaactgaaaataaggtaacagaccctcaggtctacctataagtaccttccaactgttccacttttgtaaatttagttcarataatacatatgctgaaattcctatatcccccccatactccagatcttcaktgtggaatttaaatataattccttattgtaaaaaaaaaaaawttttttttgatcaaggtgattttgataaactaaatgcatctttaattttactcacagcaaagcgattctttattttctctctaaaagcataattgatgtgccatgatctttgtctktgcatttttaaaactgaaagaacatttccacaccattagaaataagatttcttcttaaaaatattcacaaggtgcaaacacttacatgtgtatatgcaygatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataastgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatstctgtgcatcrgggaggatgggagaattaattccagtttctcaattgcaaaagtgaggctggtcatggggcttggaaccacgccacggacgcatgaagcctccccgtttacatgccaaatccagagcttakgcatccrtgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcstcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaaygcttcgtacctagatttggcctgggcagcccagggagactgttmragcactggatacctagactctgctgggctctagagaagtgctgggctacagcgcccagtgccctasctcttggggccagccagcctcaccaaaaaatcasgcttctgkcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagcccctwcccgwcccttgcacccctggatcttctgctgagtatcggattggtctgcgtccaagagctcctcgcttggccagcaggggctgcctggagaaggggaggacaggcttcgagttttttgggtagbgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgccyactcacatgtttatggcccggtgagaccgcatcctccctttctmtatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaartaagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcatwttacagctctggcatttctgggkaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgygtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattasaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggcctttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaraagttagccgagcgtgatggccagcacctgtagtcctagctacttaggtagctgaggcaggaactcgcttgaacccgggaggyggaggctgcagtgagctgagtttgcaccactgcattccagcattggtgacagagcgagactcagtctcaaaaamaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcaytgttttgttwatattgtcttgacttagaaagtgattgcaatgttaataatgcasattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccmgcttctggggatgctgcagcgagccatgattgtgccactgctctctggcctgggcaacaaagagagatcctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttsctctgttgaccatgctagaggtggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgwttaactgaaaagtatcaagcaatrcttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcgtrtttatagtcccagggtgttttcagagagyaaaagtcctttatgattagcaaattgcaggtcctcccctttctgatatttacagcccttgcaaccgcctgtacaaaaatcgggaaaaggcagaagmsggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctsaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcagaaatgcaytatgatgatamtatacttttaaaagtatatttatttccagaattcaatttgtaagaggtttgagggaaaaataatactgagttttgagtgtttctgattttaaaaatgtgttsagtagaattaaacgtgttcaccaaaacccattttatcmctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttsaaagatgctaarttatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacrtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagyctrgccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatastaytccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggasacktgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctytgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctastttttgtttagctgtttttctaatttaatcttrtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtsggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagkgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaartaaataaataaaaattaaaaaayctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatsccctgctgtacccagsaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacartcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttktaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgwtgttactgctgtaagccactttcttctccctctccrttaaaatgcaacttaattggtaaartttagttgactagagatttcatttatttatttatttatttrtttatttatttatttgtttrtttrtttgtttgagatgagtcttgctcttttgcccaagctggagtgcagtggcatgatctcrgctcaytgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggtttttttttttttttttaaagaatgcrttgattttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttrgctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctyatgccattstcctccctcagcctcctgagtagctgggactgcaggcgccagccaccacgccyggctaattttttatatttttagtmgagacggggtttcaccatgctaaccaggatggtctcgatctcctgacctcgtgatccaccagccttggcctcccaaagtgctgggattacaggcattagccaccacacccggcccarattttcttataaagtcaaatgggagatacttgtttgcargaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttsagaaaratgcasactgctttaaaaaaaaaaaaaaagggcaaggggaggtgtgagaagaaagtataattctttttcttctaackggagrtataaaaatcatataagcatgatttatsatttgattggaacattgtattttatggttgcagagcacaygtatcatcctatctgcttctgacacccagtaagcagctctggctwttataattttgatgaaagargtttccyaacagtatttcggtgtgcatgctcacacaccagccctggtcrtcagtgaacagattcttccaggtcttcattgtrgcggaagaaagtgagatcagagatcccgaggaagggcttcagtttcaccagtagtggagctagggagtagsggggcagaagccgcaggaagtcagtgcaggacgcyggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagckagggcaggtgcaatggctcaygcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttstatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgytacatttaatctttatggtagcctcatgaacaggytcttatttagttcagtggttcttgatcaggagtgatattgcctgccagggaatgcatgtcaatrtctggagacatctggggttgtcagttcaggagggtagaggataggggggaaaaggtgctactggcatctagtgggcaaaggccagggatagtgctaaggatcctgcagtgcaaaggascatgcccaccacaaaatatcagcagtgccsaggttgggaagctytgtgccattgtgcaaagattcaaggtggctatgtcacaggactggtacatgtccttttttttttttttttttttttgagacggagtcttgctctgtcgcccaggctggagtgcagtggcgtaatctcggctcactgcaagttctgcctcctgggttcgtgccattctcctgcctyagcctcccgagtagctgggactacaggtgccygccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaayctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttargtaggggtttgaggaaaatgaaaaggcctattkgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccrtgggctctttytggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccaccsacctcggcytcccaaagtgctgggattataggtgtgagccaccatgccmrgccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttcygtgttgatgaarcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaaygaggtctcatgagcaaattttaaggatggcaratgtgggggattttattgctgatgaaagtggctttcactgggaagataagctaaaaagaagacaaagcaggaaggtaattttcccctggagctatgccatcaagctgttcttctgaagtccagccgcttctctccarctgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcatartaatttttaacattgattgagtrtrgataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcraggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggagkctgaggcaggtgaatcacttgaggtcaggagttcgagactagcctggccaacatggtgaaaccctgtctctactaaaaatacaaaawtttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaatawctttttcagtctctttytccctttcccaccttcccaaaagggtgggaaatttttaaagtaaagtaataaacaaataagttttgggttgggcrggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaamtgtatttttgaaggagttkggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactrtattagtctgttttcatgctwctgataaagrcayacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccrtcagattycttgagacttatttgctattgtgagaacaccttgggaaagacctgcytccatgattcarttacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttggraacagagttgacggagaggggacaggaggtgactagatttggaaggaaaattagaaaacttttggccgggcatggtggctcatgcctgtaatcccagcactttygggtcagttkagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaattkgkgttgggccasattcaaagttgtcctgggccgcatgtggcccaccagcyatggtttggacaagcytagtctacaggttcttcaagaggggcttgagcatttgaaagacttctagtgggagagatcacaaggkacaastagaaaatcctgggctggcctgagaggcagacctgtgattattttgctctttgaaagttgtccttctgcacccattttccccagacctaacctcgatttgtgctccaggtctgagcagaaatgttattccctccaraaagccttcccykgatgttgagggatgaagttgtagscccctcccgaatgcgtcctcagaactcgctggttctcgtcctcgccctcagcatacttgctcattgtttgtttccatctctatcatctctgtgagccctttgaggatggatgtgtgtccatcttgttaacagttggmtccccagtaaccagtacagtgccagatacagagtagtaaccctacattstagcgtaggcaaatattctagtatttgccaaaactagaggatgaatgagtgrtgggtaagagagttctcagaaaaatggatataaacaatattgtaaatcatatttggaaaataaatrytagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgrcattttggcatgaytggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttatttyattttwttttttttgagacagagtctctgtctccaggctggagtgcagtggcacaatctcagctcactgcaacctccacctcccgggttyaagcgattccmctgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacasaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttgktgccattctcctcccttttgcccccaycaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgygtagcttcatcatagatctcarcttaaggacaatgaaagtcgtttattgagtacttagtatgtgctggttgcagagccaagtcttttttttttttttttttttcctccttttttgagagagagagtctcactctgtcacccagamtggattgcagtggcacaatctcaactgactgcaacstgcacctctcaggttcaagcaattatcaggcctcaacgtcctgagaagctgggactacaggcatgtaccaccacactcagctaatatttgtatttttagtaraggcggggttttgccatgttgtccaggctggtcttgaacacctgacctcaggtgatctgcctgcctcagcctcccaaagtgctgggattacaggggtgacccaccacacccagccagagtcaagtatttcaagtattaragttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcartggaaaagcctctggcctcggccttctccggaasgttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccmaaaaaaaaaaaaaaaaaaaaaaaaaagyggggcaaggggttggagaatgttcatatcacattattttggatgtctggggttgcacctggaagctcagatagcaatatctaggcacggctgccagygctctatacattsacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgsctttgtctgtagcctgccctcctctttaactgaacaccttccagacgagcatgctctgaactcctgaactgstcattctgttctctgagagaattgctcaagctgcagtttatcattatatgcctccaaagactttgtgtttcctrtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagarcatgttttccctctaaagagaggcagctsataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcakagataggatcmgathcagtacatattyakaaaaccacacttacatttaaatacaggcctttcccatttcacagtgtttctagctcccctttccaatacatctctctctctctktctctctctctctctcwctctcwcamacacacacmcacacacacacacacacmgscaaatcagacaccaayataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagwgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagcctcactttgctgcctargctgatctaraactcctggcttcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttattttaaacgtgaaaagcaatttasaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccgggcgtagtggcgggcacctgtagkcccarctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccmcctcccagggttatatgtcaatgggttaggcacagacctaggaactcagcaaatggactactatsaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtatmccmmaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatgacatgatgtaccctgtgttctgcaagctggagaacatcatgtaraatctgaaaattaggagagagaggcaatcagaaraagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttyacatacagcgagaargattaagaggtactgwattgktggttrataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaacccycagttgtaakggaggcatcaagactataagayccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctttcaccaagcgctaacattatattaattattaataaaatccaactccttaataatacwatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaacaactaccaggcctgttggaatgtctgccagtttcaacccacggggatagggtgagatgaacattgattgagcctttacatyggagacactataacaaatgctttgygtacatcagctctttcaaattaatacaattctactagaggggrcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgytatgtcctcatatcgkgggaggggcaaagggtctctctatytggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacwtacsaattttgcgaggacgcaaacatttaatccgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttygagtcacttgcactcaaaaggtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtggccactccagaccawttgatcgaaragctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgkcattaaaagttctcactggatcattccatttatactcagarkaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtgggktggttggatggraaggcrggaaagagctagcttggagatgatacgcttttccayccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaasytttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcagaaaagtgctgaaggtggcctgccytaaggcagtagcactagagcagggatggggaggacttgstggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaarkgatagatatagatacatayatacacatatatgcacagtaatagatataggtaaagaccttgatatatgtacatatattgtatgatacatatccatgcatatacgtgggtgtacacacacaggtacacacaaatatatatgtgcctttggacaaraaaaaatccccaggacagtctcatttggcttttaaaatrctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccactttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagygcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaakttttstattttmaatagagatgaggttttgccatattggtcaggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtsctaagtgagaagcagagatgaaaatgtggaaggatgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgcttttcatgtgggaaaaaccaataccaacttcagtgatattatttctccgcccccygcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaartgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtaraaacagtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaacmttcagtstgagttgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctrgtagaaagttctaactaatgactttratcgtgtgmatgtattgcagaaatggacaggrcarttctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattttgtctgaactagccaaggtctctggwgtttgctgttatmttgcttcagagammttagtgacattgaaaggctgttgtcttttttaktgtacttttggttgttaggagaaatttacaaggccatttttttctcccgtctctgcagttcaggagattatattagaaaatattctatacaaaaaatatgcatagtagggcttttctccagctagtagctcagaataagtcaktaytactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattrtactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagytccsagaggcaacccacattccttgacttttggccccctgcatctcaaagccagcaacagaaactctcttgtgcatggagtcccctcctgctttgaatctctctgactttccttgactttgatgtytaggtytggatttcaagggytcagaaactctctcatgcatgtagttccctcctgctttgaatctctctgactttcmttgaytttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctstagctytyacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccytaacctccyaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatygctcccctgaatggaggtgaaagcatgcaagctmggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttmcttttattttatttatttmtttcttttcaatackctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgrttagtgatctgattcattaatatcccttgttattaagaactgtctgtatttgtgtcctggttggcagatattaagtccacagatwccaataattaatatctwtggttgattgtaaaaatggccaccaattcttccctgtcccctgcayatgtacatccttgcactgtgaaattgtagatcyygccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctaygaacccttttacttytgggtgcgaacaarcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttayggatcatcagttttattttttcttttctttcctctttttcttttgctcccttttctccccactcttgactcttctctagtttttatatgcagtttgtatttatccatgccatctgaaatcctccttcctttttaacaagrcaagtagaaaacgaaaacaacatcaaaggatacactacmcaattgttggagccctaggamccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcastctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagwagagaatataagctttatccagggggccactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgsctgcctgaggctctctttctggttcccagatggatgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcmcactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgytgccttgggcctgtggcttytcctccytgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcackaggtcaggagatcgagaccatcctggttaacaccgtaaaaccccgtctctactaaaaatacaaaaaaawaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccrgggtggtctcgaggaggcccattaccggctggastgacagagtgtgtcaagcctgcagctcgtcccgtgtctaatggaacagaaacaagcaccytgctgcccttgttttccagtggctcaccggggctytgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgasggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctcygcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctrtcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggctcattacaggccactctgtctgaggaacactcaggtttgcaaaccgkttcttaaaatwacaggatacctagggacctgttggggtgggwgggaagaaccctatgggcagaaatgtgactttctgtagcaaagatgtactgtttcccactgagaagawtcaaaaatagaaaagtgcttccttgtctytctatattgttattaaaacaagtagatgcattttcrttgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgyrtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacataytgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtrtcagatacttggctgttttgttttttcttctwagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaarcattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgcygactgttggctgttggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatatataaatatatatatatatatatatatataaatatatatatatatatatatatatatatatatatatatatatatatatatatatatatatagatatatatagatatatgtatatatacatatatatatgtatataactttgcatattttaattgctgtctggaatcctccttcagmtggratgagaaatcatctctgggttagttctgtccctgraggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtytgatttcaccccatcctaagatcttgtgactyhagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgktgcatagaatgactctcctgtatgaatttttaaaagaaacttcaatatgctatgcatttgaaagggaagaagtaatcaccataatcttgaggtatcttttaaataggcttccttccagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagytatgatgtgkkttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctrtagctcaggttgaaagttgagtcatgaatyggggaacattcttctcttggtgtaaattagtcaccagtgtctcatagggttgggctgaaacttaacacatcccatcactttgattggctaaagtcagttacataaccaagcccagcttyagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcmtaccaaattttatatatatatatatatatatatatatatwtttwtttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcaccygccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatmtcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgarcaaaagacacagaaaggatttctttatcgtaagcacacttctctacattacctttayaatccamcaactytgstattagtaaattatagaamcaacttttgtaacactatcttgtttscagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttratctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcartctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatmaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataaygggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttytgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggaccycttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggakgattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttktttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaracgtgcatgaatctttcaagataagtgtcttattgattaycctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgwtgagaatggaaacattccataggacgcagagttattcctcaagcccctggactcgcagagaatcaggtgtatgaagcaagaggaagaagacaagaatcaggaggcaaagagaaggaggaagaagcstcagtggggttgcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggrgtgtatcctgattcttttgaggawcacttgatcctgattttttttttatgtgtawagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcwtgatgggggaatgagcatatatcaaaccaggacagtccaagtccttccggggactttgctgccacagttgacagggggaggtatttgcataacttcaccacacacagctaagctggtgatcctgctgcttggcagcaycttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttstcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagwagactgaggaaaggcccccccccscccccrccaaattgtcccgttgtctcttggctggtcttgccagctggcacacagcttyctctgaccaccctgctaggtacaaatcccacatgaaaagtctcaatcacstggctcaaactcatagttttcaggtggcataagccatggcattttcacctcctttcctggttgtttccagaargggatgatagccccagtgcagtggctctgtatttctyagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgyggaaaagggacatggcccagggaaccagagyggtttgggaaagcactttgtcaagaggctkggggaccccagggtggaagytgccatgcgcatgaggytgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagatamttagcatagccrtcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcccatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccatasgtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtrtatatatatatatataawatatatttccatgaatatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcmaacgttttgaaaagaaatctcctttcaaaaatcacagcactggttgaagcaggagcatctctcccyttaaatgcaaaaggagttaatatgccagtgaytacagtgtgcctggaaaggtcactggaggcatttttgtctggggcagcccctggagtcttggcttttgtgcttggtgagaccttatctggcytcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccaktaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtyccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagccyaagkctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatcmgatctcgtgagacttgttcactatsacgagtaaagcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggmytcagatgtcactgtgcaggtgactcacgcctagaatcctctgcctatcgtgacagggagaagcctgtgtgaccctgtggccatctcagtctctgcagggcatctgtagytttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctsgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgyaaacwctgaattctataaactgttggagacagrttctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgrttttctctgcrgaagagtagggaaaggtgacattccaactgggaatattmgactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggmttacaggtgctagccaccacacccggcctcttctcgatagatcttatttggctgacaacgaaagctgttgtgctggtagcatcatccctttscatgcaaaagataaactgaaatctraagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacrgggtggaggtggagtactaactgcaatcagatgttttatttgtttatttatttttccttcttgcgttgctcttaagcccccactcttgggcaaggctctgtgctatgctgttttatgsacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattcygaktatcagggatgaacscccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacytgtagtmccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgakcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctacsacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccttcccccctccctccttcccttcctccctccctccttcccttcctccctccctccctccctgtcttcttccctccctccctcccttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcrctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttctttttttttttttttttggctgtctacagagaaggaggatataggggcccttaagagaaaaactgkagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctscaagcctgagagtgcctgaaacccagagaggtcgtacgttgaccatgccacggggcccttcctggtaaatctaagcagaaatacaccatgcatgagacagaacaaaraaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggttkktttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagcyatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgckatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacrgaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataasaaaactayaggaggttgaggatggggctgggggccaaggagattacttggtttgaaatgaataaattgtctatcstaagggaattctttggtgcattttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagccsacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtraaacttgaaggtagacaagctctttgtgtccatacatttgatgggtcatcctatgaaggagggcccatctcttacrgcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcmtcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaamatgagtgctcaagaaatagtaaattttartatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactrgttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgargcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtcyggtgaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggasacattcagaycacaataatgttttataatgttcmttttgctttaacaagagacacatgtcagatagtagacatgatctgagaagacacaaaacccagcgtggtgattttggcagccttgccatgcatctctaacatgcacrtggccagaaaaatagcttggacattctgttcaaccctccacatsaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcmtagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttmwtccttgtaatatgtataatgactcatgagagaattcyccactgtcttccccacctragacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactarraaaaaaaaaaaaaaaaaaaaaaaaagtatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagagcaagacgccatctcaaaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtraaaagaaccatgtgaaytgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacstcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagagstgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggttttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcayttacccagattgtgtttctggagattaaagcatctcactgtatttttakttttttctacattgcaatttcaaaataatccaactcaaaggctgttgaaaggctccttctgtttaaggtaaagcctgtggcagcctttaacttcctttctcttctcctgctgccaccttggtccacartttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaaytgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattggccagtatattcaatgattcacttgcacctttaaccttgtgttgttctaatcyttttttttttttttttttttttttttttttttttgaracagartcttgctctgttgtctaggctggagtgcagtggcaccatctcggctcaccacgagctctgcgtcgtgggttcatgccattctcctgcctcagcctscggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtmctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggaygccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacwtaagaatcgcttgaacccaggagacgggggttgcagggagctgagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcasccccactaggcaactagatttcagcatggtaagamcctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacayggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggamtkcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaawagtaaatgtgttttttgctattaaaagtaatgcggttttasttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctrcatggaatatttgtgtcttctcccccatttatttatttaatcatttatttatatcacrgtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctyctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacytgattggccamctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaaratratgccgacttagacagtgttagtcaacatcaaatgtctggatcaagagaggcaagaatcccgtggattkggcgttggccagaacttgtctggaatcttgttttctgccttsagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaayttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaaccygttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttwwtttttttttcctctgcaagggatggggtcataagacattggtgaggttaggccttcctttgtctcccaggagcacacttgatagcaatgtagggtgaattccaaatctstgagttagtgccrtatatagcagtgttgtcagtaagatttctcactggcatctctgcttcccctcttgactctcttgaaatcccttcttcaggcagaagytggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactggstgaatgaacgaaagasgccataygcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattmtgagattatgttcaacagatattttcagtgttaaaatattcttttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgattkaaattattctgkcttctatgaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccasagacactctcttcccccacttacttggccaawtttttttttttttttttttttttttkggkggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaasttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgktttccttcccactcacatgtaggtcacctacgggagcargggaggaaccatytgaggtgtttttttttttttttttagatttctcattgctgagaacagttccagctctgcygaccaaaggctgagtgtccytttattagtctgagcccctagagaraccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttwaaaaaaaaaaaaaaaaagttctaaatcagtggattctgccgataaacatcatctggacggaatgaagctgagggccaatagtttagaggctcagcacccgactggagagagagagagagagagagagagwgwgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccarcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttakcgctgtcaacatcatctccgtccacatcaatgtcgtcatcgtccttatgaaaagccckgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaagtgcctcrtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcarcaagtaagaatggagtggcatctccccacctgctctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcgttccccttgtctgtgcaattcccaacagaggcaastgcgcatttgagacaggttgagggttcaagctgtccaatccctgctcatctgcagcacaccraggaatgtggactaatgaaaaataaactgcatgcatgcartgcccatcacrctgcctgcattttctaatcttcacaataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccrctaccaccttccaccaccattttttttttgttkcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctggsttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacacagtgctggggcagtttcatagcctgtgaccacacagataggaaagtgacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgktgktgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcagattgcytgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctargtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagwccttggaaaatgcaaagagggggaaaaagaagaaaaacagcaacgarkttattggagagttaamacttaaakactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaaktgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctrtcaagctctttcctatckaagggttttttccatgtactggtttctctcctgcgtggtcttgttctacccttgaggagggtaccacytcctcattgcttagttgtcagtataaatgctyctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagmctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatytcccatcagccgaaactaactctgctrtgtcrcgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccartgccccaatctggartccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctcyaggtttctatcattacacagattagcacayggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgarattacaggcgcccaccaccaarcccagstaatttttktggttttttttgtattttagtagagacgggatttcaccatgttggccaggctggtctcaaactctggacctcaaatgatccaaccgcctcggacttccraagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgktgcccaggctggtgttgaactcctggcctcaagcratcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccrtgcaatgcttgagatttgccctgtgactcaacccaaatctaaagcccgagtcgtatgaatccagracacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctkcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgkaatgtgattctccttaacagagggattcgtaagcttargamtgataragawttggcttttctgctgttggattgatagctccttgactgctgaagccattgcccatctgttcaactgktgkattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgkgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattakgaggattattttctacctagatcaggtataaggtggatgtattattggcattcctaggactgttttaaaggaagtacctatgaggcctcrtgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcmcctgtaatcccagctactcgggwgmctgaggcargagaatyrcttgaacccgggaggtggaggttgcagcgagtcaaggtcacgccagtgtactccagcctsggtgacagagcgagactccgtctcaaaaaaaaaaaaaaaarraaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcayataagtaaattatatgattggayccaggcataaaacgtgatttgactcccccttgcccatcacagttctggagttcacatatcatttgttactttgaaaaatgaacttttgttatttgattatggtrataaataatatacatggtagaaggagaagaaaatgaagaaaaatttagaaacttggacagaggaaaatgaaaatgttctattaattccactagcatgagataatcactcttaatattttgktgcatgttcttttctttcttctgarkgatagcatttttttcaacaaattgggctcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcrggcttatttwactatttatttttgccttacactttttgtamaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagaytctttattggtaaatgaagtcagcttagtgatatgagaawtatgaaacataaatccctttgtaaaaatataaaataatcttacaatcatcatcgtcatcctcatcrtcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacwataaactgagctctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagaraaacacaacattgagtgaggtctagggtgaatrccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcstaaggaaacttaaaatcatggcagaagatgaaagggaarcaggcatgttctgcatggctggagtaggmggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaasactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcarttgcrcaattcacacaccaggctgccactttggcccctgcgtcaccttcaccaccacccaatgtgtcctgctcatcactgaggtttgtcatttttactytgagtctgtccattgtcatcatctccaccatcaccccttttgttytcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgktgkccttttttattaaaacaggttttgkttttttgtgtgtgtgttattttgttttttgtttttttgtttttcgggggctggagtagtgtgcaragcctggcggtgattgttctcattaraaagtatagtgtaatactcaataaattacttttgttctcaccttgggaagtggactmagaggccaagtgactttgatttttcactttatcctggagtttctcaaccttggcactattgacattttargccaggagattcttkgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatyacatgctagggctgggcacggtggctcatgcctgtartcccagaattttgggaggccgaggcaggcrgatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggkattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcrcttgctttgcaaascactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaasggctgtcaccaccagaaatttaacatgctgttagtgcatgcaaaaaaaagcccagtaattgtagsgctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatayggatagccttttcaaaaaatgcatgcaactgagactattggctatgttttgtttattacctactttttccatttaatagtatcttggasattatttggtaccagcacatgtagctcaacctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgaraggtggggarggggtgggggctctgtgcatggaatggggggaaaagcttcagggaagggcagtgcaaattgtttctggactgatgccatctyytaataatagtagttaatagactgggtacaatggctgacgcccgtaatcccagygctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaawtgcctartaaataarkgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactcagttcaagaaaacctcactgagcacytaccatgtaggtgctcatcccgataccactatcaggmccttkggaccagttgcaaggatgcaggatgaggaaggcartgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtgrtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctratttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacarggataatagacaacgctatcaagarggggsccaaccacacatgtgcagccactgtatgacgtctggattttccttgasttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatgrtcagaggagttttgagtatcggatctttgtgtacttgytttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcracagagtgagactccgtctcaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgcyctctgccccgtcacatcacaytctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccrccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaycctggaagttgagtgatggggaataaarggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttccactgaagctacaactggagctaagcagatggrtaagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatkccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcastttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccggtactctcagagccctgattttcttayctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttayttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccasaaaatagtgtatggattggtgattttgactaaractggaatgtgggtgtgtgcactcctcatgttccggtttctgtgatcattcaggcatgcacaggtatcctgatgggtarccaggtcattaggmccaragtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatayatcctgataaatgctgtgccttcctccttcgtctcyctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggytccacagagcagtgaaaagactcccgccctactgctcscaacctcaratgtccctggscacwagcccatctgtatgkctttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcarggtatargggtcargcagctgtttgacargattcttgcaaatgtttttggtttctctgtctactcattacgtacactctgccagaggttgaaaactcaatgttgagatyacatacatcctgaaaacactgkttaaataaaattttggcctgcatcctgtttttgaaaacttgcartggcttgccaacgttttcaasttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccmaaactccatgttgtttacagtgygggacacctgactttcaccttttatgatacctgcctggggcatgcatgtggtgactttttccatctctggtctctatcttatctcttgygatgaactcaggtctataaagcatttgggcactgcctggcacataggatatgtccagaaaacactagctggtattaaaacagaggaaacatgggaactgagggtggtcagtgacatsacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcytggcatacggcatcagttcagcctggcmctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaagraacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatstaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgmcrtaaaaagacctatctctacaaaaattagctgggcatggtgtcacgtgcctgtagtcctagctactcgggaggctgaggtgggaggatcgcttgagccccgggaggtagasgcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatkgtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctsataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacrataaaggaaacatcctagacacttgaatcagagcccttttaattatgacttcaaaaaacagggctcgtgccacccaagatttcctccatatacaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattakccccagcccagctcttcrttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagttkttwtgtaccagtgaggatgaatgtttctgcatgtgggtagttggcaccrgtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaargattgcttgagaagtttgagattggcctgggmaatatagcaagatcccaaccctattaaaaaattaaaaatgaaaataaaattttaaagaaaggtatttctccccttcacggtaatttggagccartacttcttgcamcattcatttgtccacagcatgggacaaaggataatgccttaatgcctgctgmaaatagaacagtggtgcttagcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattayatgaaaaatagagacaaagtctcgctttgttgcctaggstggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacaktcgtgayttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatcccctcctgcacaactgtggcgttctctttttctgactagstgattctgctgctgctggatttattcattcttctccctcacarttttggctcgcacatgmttcctttttagctcatgrccgtgcarttcaactcaacctcatggcatctttttatcarctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccmggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcmgagcataggaacactcatagtatgtatcagaaactagtgaacacatgttgttttacagctctgtctgcaaaattgcatcgtgggcctctttggggagtgttctcartgtgatttttattctggggtgtcctttggccacaatcctcaggattattttttctctgtgctgttcactgtaacatcgtccaccctctgagatcttgcttttcagtctactggtatctccacttctctctgcagcrtgatgtctagtcagagtttccattctgtttttatgaccctgggaggactgggasagatctgtgaggtcatcttrtccaccctcagccagggcaggagtattccctaatggtagagtcaagtgtttggtttggtcttgtttctaatgactcaagtgatgaggcctggggacgtcccytgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacatggccatatatgttttgcttgtgtggtgctaaaygcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctcyatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacrgattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacagsccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaastctcattcacttctttctatttttcctctctctattgcatattaacccaccatattgagagaayagaaacttttgccttcattatatcacctttacaccccaggacaggtgccctcctcagcggagasaactgtccccctccatcckgcaggagtwttgcagmcatccttccagccactgcttctctaccggggcaaatyytcccccaagggataattgataatgtctgaggcatttttaattgtcacaacttggggaaggggcaagggattgagggakagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcakrtgtctttattagyggcatgagaacagactaatacagtcagggatgctgcagaacatctccaaacacacaggactcccaccctctacttccaccccaccaacaargaatsattcagcccaaaatgrcagtagtgaccttgttgagaaatgctgttcaagccatacrtcaccattggaaggttgccaaactgtgctttgcacacacatgctgtctgcacgccttgtatttttctctttgcttagtcytgctcatgctstctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgkctttattatatttggarttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaasgattgcttgagctgaattgttcaagacygccctgggcagcacagtgagaccccgtatctacaaaaaataaacaaacttagccaggtgcggaggcattcacctgtattcctagctactyaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgkcttgtccctccatctgggtgctttccagtcacagcctggatgcatgtatgaataaacttctaccattaagtccctgaattatttaagcactgccagtgattctatataaaccgttcagtaaaatgaatkgcatatgcgtatgtttcaagagctccagcagcctacccaggatggcttgatgttgtctcttarcaccgtatcaatacctgggggttttcaartattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaawgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacacttygggaggctgaagtaggctgaagtgggaggatggttagagcctakgagttcgagaccagtctgggcaacaamgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatgggygtatcaggagtttccgcttttgcttcttcctcattttctcttgccacygccatgtaagaagtgccttttgcctaccaccatgtttctgargcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcytaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctyttaatttcmtgcttcttaaactggggtatgagtggccccaggtttccctgttgggggtactgataccagagttcatttgaagtcattggaaaccaaggcatattytcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcarccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccamataatccctaaccatgataatacaaatataatagaaataattatgtttgtttaaaatatacacagaaccaaatagtcatagagtagtatttcaggtggggggccctcctctagggcagwggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttragcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtsgtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccrtggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccatraattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagcsccagtctattccaataccaggattgtaaacacagggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagakaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcytaagtgacttcagactctatagacagtccctgacttatratggtttgacttagattttttsacctttgggatgctgagaaaaccatacacatccagtagaaaccgaactttacattttgagtttcgatttttttttttcacctgggctagtaatacgtggtaggatactctctcacaatgytaggccacagcagcgagctgcagctyccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactytccacactgttttccatagtggttgtactagtttacattcccaccagcagtgtagaagtgttscctgytcaccgcattcacgccaatatctattattttttgcatttttggtaatggccattcttgcaggagtaagatggtatcgcaaatgcaacaaaaacaaayaggtgggacttaattaaactaatcagcttttgcccagcaaaaggaacagtcagcagagtaaacagacaacccrcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatamagatggttaatgggatttttgkrgtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcrttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaastggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacactagttacgtggactgtcttagtcagtccaggctrctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacrtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacrtaaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatayactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagcctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatmtataaagttatatatatatatatatatatatwtatttattttcaagacatggtggcatgcaactgcagtgtcagctactccggaggccgaggcaggagagtcacttaagactgggagctcgaggcggcastgagcagtgatgactccactatactccagcctgggtgacagagtgagactttgtctcaaaaataaaatataaaataaaataaaaaggaagaaatagccagtagtgctttcttgtagacagagaagctggtgaaatgrtgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgkttggttttttttggaaaaagaaagaatcaccataaaaaagatkggtaactcrgaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctytactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacrcataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcrattggcacctcagatggttcttcctgacagctacccttgcamctgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccsaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccaygctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatatatatatatatatatatatatatatatwtatatwwatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattacaggtgtgagccaccatgccaaagcctaagggaccttagaattttttcycctttcttttcacattttgttttgtgcttgcttatttattgaaatctggaccacaaataacttacatgtttgtcaaggccagatttcaggacctaaccaacaccygacaggcatcttagaaagtggagggtgtaagttataaagagagattacttccaacacgtttctttaaagcctgctggctaaattaggtgggrccttmtttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatrctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcrttatagatgtcttatatccattcctgtatcctttgtgatgtcttgagtgagaaaatgctctgaccaataagccaatgttcaattgacttcgaaatgttatgtgggataggctcattcagggtggtacggctgtagasaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggygggagaatcgcttgaacccaggaggcggaggttgcagtsagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcatttggggggaaggtaagggaactggggaaaagaagrcaaaatgatgacttaaagagactgatgaacccaaagctctcttgtgaagcccctkctagaataagtccgtctcacgttacagtgcttaggaagtgttagatgtactgtcatttcttcaacatatatgtcctatattagtctattctcacactgcwagtgaagacatacctgagatkgggtaatttgtaaaagaaagaagtttaacggactcatagttgcacatggstggggaggccacacgatcatggcggaaggcaaaggaggagcaaaggggcgtcttacatggtggcaggcaagagagcctttgcaagggaactgccctttataaaaccatcagatctcrtgagacttattcactgtcacgagaacagcatgggaaagacctgcccccatgattcagttacctcccaccgagtccctcccatgatacgtggggakgatgggagatacaattcaagatgagattttggtggggacacagacacaccatatcatgtcytggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccartggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatayggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcagrtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaatyaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtktctgaaggatktttttttaaaagaartattcatttaggtgacacatatttattgagacactaatatatgccaggaattattctattggtkcctttggaggagacatgaataaaggcatggatgtgactgaggaggtaaaggtgaasaattggggaggggtggatggggctgactcatgacctaaagaacatggcatctggrgctctyttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagygcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctrtaagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgkcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctcctgtagtagttatggtcactsactcygggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggrgtcagtgtctgtcaayrtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctytctgggttcactcctgacagttctttattgctttcccacctctgccaaggtcaaaaatggaacttgcttcttgttctcgtatcactcagactaagcagttgatgtaacagataacccccaaatttcagtgrtttcacatttaatctgtaaaaaatgaggatttgtttrtagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattmattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctagtgaaatgacaagaatccccagagctgggaaaacatttccatgcaattmcctctcagtttacatcaaaatcakctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttgkctgtgtccccacccaaatctcatcttgaattgtagctcccataattcccatatgttgtgggagggaccgggtgggasaatattgaatcaygggggtggttcccccatactgttcttggggtagtgaatgaatctcatgagatctgatggttttataaggsggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctcnnnnnnnnnnnnnnnnnnnnccctcttcctccctccctccctccctccctccctctctccctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacartttattagggctttatktaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttaytccagcacgtggcatcgccagtcccagtgcccttgrcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactycatctcaaagcraaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcscttatgtcaagcttctttcagtaacaacwgaaaggctaatagtagtgctgtgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccackgtgttgcccaagctggtctcaaactgaactcctgagctcaagygattctcccgccttggcctcccaaagtgctaggatgrtgataggcaggagccaccacacctggccatggataacatttctataaaatataaccatattttcaaacaaagagaaaagtggcgttgtgctacatttcttctccagtgcttggttccctagaagacagccarattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattsgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggargatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctsaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatayggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccamcctagcctcctaagtagctgggaccacaggtgcatgccaccaygcccggcaatttttttttttttttttttttaagtagagacagggtcttgctgtgttgcccgggatggtcttgaactcctgggctcaagcgatmctccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggytttttcggttgtgaagatcagtaccttgaaattcagaatagatggcatgaagcacttcagctttgcattcaagtactcatgtgtatgatcaagcatcgtcatgatcattattgactggaaagcctgtaagaagaagsggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgycactgcactccagcctgggcgacagagtgagaatccgtctcaaaaaataagtaaataaaataaytaactaggctaggcacagtggrtcatgcctgccatcccagcactttgggagtccaaggcaagaggatcacttgagcccaggatttcgagaccaacctggacaacgtacagagacctcatctctacaaaaaataaaacagctrggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtrcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgkgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggmgtcaccacggccaccgtgatgcctggctcaagtactagttctatgtcartgatggtaccaatggactctaactttagaatgttgttgactgaaggcccctgccccctgccttgctttargtggaggatctggtcaaggctttgtgaatcaggggatgctccacacctttctgctctctgcaacagggccagggatctgagtcccttcttgtctayccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatycttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggsactacaggcgcatgcctccacatctgactaattactraatttttaaaaatttttttagacactgagtctcaccgtcttgccctggctggtctcaaactcctgggctcatacaattcccctgcctcmgaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcmagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtcygactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacmactgctggattatctagtccctgaacagccatttatatttttgttacgcttgtggtttttaaatcatcctcatttccttgatcgcatttgcttctcctggctrgaatgtgtaggagacgggtcggggagactgtgcccatttgacagrtgtgaatgcgracagaggctgcagctggttagaccagggctgtgcaaccctagagccattgccyygaccacaaagccacagtctcctagtcctaatattaagaggtaggaggtagrtagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctrgattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaattttyactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggcyaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttmcctgcctcctatcctctcttcccacccsctacgatgtctatgtatagtttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactagggrtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccacttctagctctggctcaggttaagtgttkcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcagaacaggatctggaggcagggaatctaaggctgattsacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccmgtgtcccttcagccaggatctttcctggaagaactcagtattaaggcacttgattagttcttcctgttggtggactgattgattacatttgaatctttcagcaagcttttggctgagctgggcatcttccccgccttcctccacctctsccttcaaaagcctgaayttccmaggctttctsmcatgagtacttagctttgaaaaacatgagcatatttttsattcttcttgccggcctctccctgygtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccaccccctcactgccacaccccctcatagatttcytcttttcctcctccttctcctcctccctcttcctcctctttttcccccmccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggamtgagcatggtggctcacacctgtaattytagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacmattgtttcctcgattactgtctgcctcttcttccctagrgcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccagrcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcstcttgccctctgacacggcaaacacagatgctgcccraatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgtkacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctcccyccaacartcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctyctgtggtctrtaagaatgggaccaggaytcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctrttgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttrtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagamagccatttctgcagagttaaaaaatacgtaggttcagttccttaccaacaygtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataagaaggaggaggatgaggagagagacgacasaaaattcactcacagaagtgaacataaattctaacattggtaaaactttgtctttgttttaaataatcagtcagttgtctcaatccataaaagagtatctcttgtacaatgtctgcttttgagtgattcacttsgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtstccaataaatttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccagstactcaggaggctgaggtgggaggattgcttgagcctgggaagtcaaggctgyagtgagcaaagatcacaccactgcagtcaagcctgggtgacagggcaagaccctatatcaaaaaaaaaaaaaaaaaaaaaaawatatatatatatatatatatatatatatatrtatatgtatatgtatatataaatttaaggaagcatagaattgaagaggctattccaaggtcacatgacttttaagtggcagaaacaggggaattctgtctaacacaatccaatttatccatctcaagaaaagagataygccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagyctttggatgttttaattatataaaaaaagcatggaaactgggcattttaattagcaagtacagccttgacacaaataaaggcatggctttggttatgcagtgcatttatttgrttttcttgaaataagaaaaaaagatwtcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcasacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactacmattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagyatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttgrggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaakaaattttcctataaataatctttctgattgacagatagcgaccttcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctaktattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgytacctctgcatggcagaaactrtcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtrtcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcagkccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacattactcagsccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccrggagcaaagctgctgtgggacatgagactctttsaggcagaatacctctcatgcctggagagcattacaggctgcattastctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttstttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttgstgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgagratgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcmtacagcagctgtgtcttaagactgtgccctttcatccaccctcttggtactcaaagcttggtccatgaaccagcagcttcagcatctgctgagagcttgctggagrtacagaatctcaggcctgactgacccsaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcayagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatrgtagttaacacccagtttggtragtgttattattgaaggctgagaacagaacgacaaacaacaatcacaacaaaaggctggggaagattttcctggtggggggaccagatgagcaayagatctccatatgyagaggggtaactgagtacgactctgggacttacactagaacattcatattgcaataaagsagatttttcctgagcacctactctgtgccaaagcactattgtaggctgtggagatagggagctgaagtactgaaagcgttacagtcaagggccagaaaaccattgttcaagcarttggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaaytttttacrtagagtatgaaactctgttccaaatctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgsgtaggayatgtgaaatatttgctcagagagatccagaagkgttgakvtgagtaggatcagctggtgctccaggataaaaatcgtgtcaccacttttgccgaaaagtcactgtgtttctcctgtactcagcaggttacagggtgccatattgttytcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcstaattccctgtgagcttgacacaggaggccgcctcctcctccaggcyyacttggargcattctgtcctcttgttggaagggaaattggtatggtagggaggtgcttcttctgggagtgggtttgtaaaatyaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcamttctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactayggatataacasttgttcttttttaaaataacttttaaaaacgcaagtgttgaattatctgcatkgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcrcggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaaycctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtgrcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtrtcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggasagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtstgtgtgtgtgtgtgtgtgtgtgtgtgtgtttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcggggggtcggttattttataagcaaagaagtacagccagtatgattctgaagcaactaggycacagtagaaaaaagttggagagtgaaatctcaagcaagccaaaaagtgatagatgagttaaaaaaaaaaaaaaaaaaaaagttgcctggcttggtgcagtggctcatgcmtgtactcccagcactttgggaggctgaggtgggcggatcatytgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaargtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgastccaggagttcgagatcagtgtggacaacatagggaggtcctgtctctacaaaaaataaaaaataaaataaaaaaataaaaataaaaataaataaaaagtagttgsgcgtgtgtkgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaacccygtctctactaaaaatacaaaagtkagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtwcacccaggaaagagcaaatctggggtccccacgggccaggactgggatctggactgggccatggcccattggatggcagaaaggttctcactgaagcccccataaaggtgggactcactgggaaaccsctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagscgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaaracctctctaaaaaggtgacatttggagcagagacatgaaggaagggattgctggaggcagaacattctaggcagaaggaaccgcacgtgcaaaggccctcaggtcagccggcatggcatgcaagtaagccasctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggayaggtggtgaagactgaaacagggtatccagttaggaagctaycacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaatawgagttggatcacagcaaaggtgagctttaacgagttcagtctagctctctcwcaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacytgtaattctttttttaacttktattttgggttcaggggtacatgtgcaggtttgttatataggtaacttcatgtcacaaaggtttgttgaacagattatttcatcacscaggtaataagccttgtatccaatagttatttttmtgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctygcagaagacatgatcrcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggcyaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagccsctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaagrtttcaggaatgttcagctgttkcctagcttggaatggaccatcctctggtcccacccatgggtaagtcattggctgcagagcgcagacatttggctcccytcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttktcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccktctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgamagacccattttgtgtgtgtgtgtgtgtgtgcgcgcgtgcgcacacgcatgagcctgtacgtgtccccctccccccccacacatatgcacataagatagcataaggtagttccctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctcyccacaacttcaccctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctrtgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcractcatacctactgttcstcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattrggaatgaagtttaggtcagaaaagtttcrgtgattattttttcagaatcattgtttcttggtttctagggtccaacatgccattgttcaatggctgtatttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccwaatgctgcttctgatctccatctatttcaggggatgaccagtctgaataaaaccaatgagcttaatctacttgtggaatgttatagccggaagggattcatagagatcactctatcrcctaaaattctctcttctacatatctcastgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggsccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcatcccctcctctccagycctcacctggttttctcttctccttccaagaaaaaacaccyataccattcttaacatctctggaagctgggggtcaggagagggrgatccataaagttcttgtcttccccgaytcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagmggattccagcrcaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggmggaaaaatcatccaaactacttggtaattgrattcaagagtgatggaccaaaaattattaatgcattcccttccstccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattasaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacakgctcctgttaagctctccttacagtgtgtgtggcactgtgcagttgaatgaaacatgccatggccagtggaracaggcttgggctgatggagagggcctacagggccaggccttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaagccctatgcctttgggaaggagaggaaggastaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatytgtgactccacttagtttttctccacccmggagccctyaggccgctggtgagtgaagttcttacccattagggattattaatatactagataagagtacagtctctggagctaggyttgtgactttgaacaaattattttatctctctgagctcagtcycctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggwgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttayagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctctkaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgkataatggttttaaaatacyaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgmcctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtmaatgacttcaagagcataggtaacagtaaaatgtagtaaaasaatttagaagtcatgagttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccccstaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagkggtagcaagtgttttcctgagttctgtcatctgctscagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctrtccttatgccattgccacaytgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttygttaattcctgtgaccatatggcagcatggttaggatcttgggcttcyaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcmctgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcawacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcaccttgagctacacatcccatagtcagcttagmcctstccctggtgcgggggagcaggackgttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggartaacccagccccaccttggatctctstcctctacttcccacatgtatccttttcatggttaaaggtagaaacagaaaaaaacaggcagaaacataaaaagctcggagatggcttcctattgcttcttcattctgggccagagcaaatcatatggtcgtrctccagggtgagsaagtatgtcccacttacagactgaaaaggtgctgcaagtctgcacggcagagggcatggataaggggttcrtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctamtttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccarttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaargacccatgccatatagcaaagttcttagtaayacaggctttgggttacagcaggctagattcaaatcytgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaascatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacmtgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttyttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgcagtggtgcgatctcggctcactgcaarttctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaasctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaawggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagkcaaaaatccactggaggccaggtgcgttagstcatgcctgtaatcccarcactttgggaggtcgaggcaggaggatctcttgaggctaggagctcgagaacagtctgggcaacatagcaagtctctgtstctacaaaaaatacaaaaattagctgcgcgtggtggcgcgtgcctgtagtcctagctactcaagaggctgacatgggaggattgattgagcccaagaggtcaagacggtagtgaktcrtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttktttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgcygtctctttaacggagagttcatgggcwgggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagrttttcttatgaaactgattttwctcaccagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaargctagaccctatctcaaaaataaasaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggwgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtwgtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcmctttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggcygaagcaggagaattgcttgaacccaggagggasaggttgcagtgagacaagatgatgccattgcactccagcctgggtcacagagcaagacttcatctgaaaaaaaaaaaaaaaaaaaaaaaaaaagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtcttgcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcaragtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcaytgascttgtgggctcaagcartcstcctgcctcagcctcccaagtagcttagaaccacaggcatataccaccatacctggayatgtttttaactttaatttttatttttgtagagatgwggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatrgtcagagctcaaaaattgagtactgcttygtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacmcttctttccttcakctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaatgtstayggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggtaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatrtttttcgtagagtcagggtttcacagtgttatgcaggatggtctcgatytcctgacatcgtgatccgccygcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccagsaacatttttctcatcttttgaacattagggamtaacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatrcagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtaragctgcttgtttgtctgatacggtagccattagccacatgtggctatttaaactgaaatgaattaaagttgtataacatttgtaaaaatcacttcttcggtttcattaactarcctcatttcaagtgctcagtagctacatgtacstaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaaccyctctgaatatgctcctcctgtgatacccataggkaccctgaacctctagtcctcaagagcagtcattcacccctttggactatggatccstttgcaacccaggaacaactactgtatggccacttcaaacctgtatatgctgcaagtattttatwctaggtagggtaaataataggtcttagatataggtgcaaataattttcaaatatgggtaaatgctattgggatgtgtaaagtagaaatccattttaaagygttattgaatccatactaacctgatcattacatatttactaattgatgattactaaaaatgtggacctttgtgaatttccgatgtcanagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctrgcaaatctcagcaccaatagaaacaccaagaacatggattcatcaaaggaaaaatgttgaagtttccattttkatgcttcctggtaatccttcagcccttgatggaaatttccaracctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaataytgcaggcagagctggggattccgtggccagagcatatttggtgaaccgaggacgcatcaaagagcttctctggtgttyagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtrtattattctgcaattgctgagtaattgatgatcsttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttaggtcataagtrtttttcatttaattttttttccccttmatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttascaatactgcccaggcacatgggctgtggctcaagttttcagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgmccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacacttyttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttggstactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaaraaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattctttyttttttttttttttttttttttttttccttcttcaaccctgactctgattcacaaagaatagggaagcttagccaactgcagtttcaaagtattgcttcttaagcctgggccaagtgtgtagacttgataraattctgattaatgcatcttattacattaattttagaagaaaccagaaggcatttytcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctsgtaggtcgaggctgcagtgaactaagatgccacaggactatagcctgggcagttttgagtgctgcctctaccatgtaactagcttgccagtcaagtcattaactattcggggcmttagtttcstctttyctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacrgggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtayactgtcccttcaataaaagttgctaacaccaccaccttgcccttgaattctttcctgggcaaagccaagaaccctgttggcctaagcygcarttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacatargagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctmcaacagtggaagtggtgccctgaatacgccagaaataatcgtggagtcaacgaagatctgggagtattgtttggagacatctcagtattsctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgaratataatgacaaccttsstgaaagcaagaccacagggcctrtcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggaggstgggtcggaagccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactcttyagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgmtgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactraaagaaaaaaaaaaaggaattagaaacagagaaaagaggcttcgtgttgtttgtaaatttgtgaataaatctgttaaagaaatattggattcatattcaacttggaaaacagggaaaggccttttattgcatgcttwgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcmtgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgytggggagaaacaagcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgmacgtgagaacccctggtaaacccatcagatcttgtgacacttattcactatcacgaggatagcgcaggaaagaccggcccacrtgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatktgscttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccrcctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggwgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgwagacacttgtttttggatttagggtcttcctggctgatctcatstcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttmcttagctgtcctctgcctccatctccctttcyctgtaagtggaagtggtattcattgatcacacactacatgccggacwccaagctattacattttttgaatatgtttcttcyttgcctcttgaggactaaccagccgggtttagattatttcctccccgtgtcgctttcctgcccccacatgttawagatggtgcamgggaaccagagagctttgatccctggtttctctggtcacaaacctgctctcctctccagaactccaggmtgcctttctgtgggggctaaatcaaatttagctgttcccccaactgcaaagtacataggcatcaagtgaaagggtaaatgcatgaaaacctgaatggctgatcctctaagacagkgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccscatctctactaaaaataaaaawaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaawccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctrtggggtgtctaccatctaaagtycagcactgcactgggcatttttaaattatcattagtatataattatatataataataatttaatttataactatatcatttattaaggtcctactatataccaaattctatyggacacatgtcctaataataaacgtgatatmatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcntccccaacctaaggaaactgagacccagagrttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacrtatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggasaggatgaaggaaagaagcagtrttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttykctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagasaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggcyccctgggagtcagagcgttccctmcctccttgccactgtaaatgactatttctgtcgtttgcagagtgtccttttctttctcctacagccccatcctyaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttsttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctgtgttgctcttgtcacttttgcctggatccactaactcacyacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtgkccctctcaggagggattgtgattaaagaatggacaacccaagggaatcatgtgtcatggtggagcatacaggccagcasgtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatsmctgcagcctccaactcctaggctcaagcgatcctccagcctctrcctgccaagtatctgggactacaagcatgcactcctgtgcytggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttaytctgtgttgcatccctttggcttcagcctcattgtcttgmgtttattaagcatttggaacatttcagctgaatgastgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctasaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggkgaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacamacatattgatatcagaccttayagcagtcctattggctagatcagttattatgaatgtgttttatagagtaggawacagagatgygacgtgacttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcatttttttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggrgagtggaggttgttctctagaacatagaagccgcttcttcatcccacacaatggaaaccagagcccagattatattaacragaagttccagaattgcagatggccctttgctgcttagggaggggggagaagaagaaggagaaaaagaagaaaaagaaaaagagcaggtggaaacttaaaraaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtcyggagttccagaccagcctgaccaatatwgtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatwtaaaacagcaactggaggatcctgrtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccacygtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattsttacacagtttgtaagtcttaaaactcagtatckactctagtagttgctccaaatgtgatgtcstcataaatcaccgagggatcttgttaaatttggaytctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtratcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgacygtggtgagaatatttacaccatggaaaktggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttayacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatyggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtsaaccaagatyacgccactgcacaccagccgggggtgacagagtgagaccctatctcaaataaaaataaaaatagaatacaaggggggataaagatagacttaaaatacgctctctagaaaaaagwaagaaatatggaaakaaatctaatttagaaaaatgcacgcacccacagrcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgcaacaaacccacaaatgamatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccmcaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatrgcaacagcacatgtggagggaaagaccgcagaattctggcrgggttataaatcatacagtcaaataatttccgtgcaattaatatcctcaaattaaaacatacstttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgasagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctsttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattggrggaggtactttgggactacttctcwaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccmcaactgagttcattattstgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatsccatacatgagattcccaaaatagacgggagttacacagagacctttttttttttaacctccwctgagattttttttaacctcctctgagattctgtatttccttaatgasccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaaraaagaaaacaacyacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcatraactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcrggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtcmgacacatagagatgctcaataaatcttggctgagkcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaacwgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatcaatagctttctaaaatatgtagccagttaatattttacttytgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccrgctactttttgtatttttagtaaagatggggtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattatwacctttgttyttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccraagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggwtgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcycttgarcccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagtgtgtgayagtgcttaaataatttatctcacatatgcaaagagttttggctaagggaaaagaaaaatgtgaacctcctaatagaaaaatgggcaaagataatgaacaagaaattcaytgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacakctgctgtttataggagcatamattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcrttattttgtgtgcatacatatttatttagttatttgacctattayattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgkataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtgkatgtatatatatgtgtgtgtatgtatatatatgtatgtatctgtatatgtataatggctgkmcatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttytaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaattaaaaaaaaaaaaaaaaaaawawawawatatatatatatatakatatatgaaaaaaaggacaaacgatttyagttgcacaactataatcgatgaagtggctccttgatgttctcggggyaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgatttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacatraacttttggctggaattgtggaatatgaagtagctcccatccttattccatcgcccatatgctaaaatgtagattgtattagttgagaaattttaccaaatatttacttatactgtgstattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaaygcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctatatctatacacacctacgggtgtgtctatatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcagsagaagctgatgtctcagcttgaagtcaggcatagagaggcarttctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaycaatggaccactggtcyctgctgatttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctrttgtacaatatatggtcttttgtgattggcctcctccacttagcrtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagasagaatcttgctctgttgcccaggctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacaggctgtgtggctatttttctccaactcctttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgkgattacaggcgtgagccaccgcgcctggctttcaaattccattttttaaagttartgctttaatatgttaaacacccttattaacatattacatatgttaatatgtaaaataaaytccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctcyttctcttccttgctgaggcttttgacaatttcaaatgctccctgaacctcagtttcctttgccacaaartagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttgrttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggamaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgyggaactaatttttatactgccaatctgaggccttttctgacctcatcgctgccactgtaaaatgarttctagccccagaccatgacatgcctactagcttagctctaaccaraaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcarataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcycscagatagcctcttagcagagycaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagsgggaaattgctttccrtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattrtaggcatgagccaccatgcccggcctaatctaatcarttcctttaaatctgaaactgtcygcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggarscagttcacgcttggatgactctggagctgtggtgacaatctaaatcctaaattgaggcttactaggaaatgcactaggtracaggctctagagaaatggctattaccaggttgctcaggctggagtgcagtagtgcaatytcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggawttataaaggaattctggttataattgcadgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagawttttttctttttttttttttttttttktttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgcygatctcagtggcrgccatcttgctttgtaagccttctctagctttatgatgctcccagtatataagacatttccagtgtctagtccaaattagtatttctctaattctcgmgtgtctgatctgcctggctagaatgattaaaacaaaaaaayagcaaatcaktttgacagtccacttcattaagtggaggacagtgttttgattgctatttaatctgtttttccttctgtctgttcttggctatatggaattcactttgcctcysttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctrgatatttcaactagtttacatgactttcttacctaygctaccttataatccttttataaattttgctttacgttttaacaacggaaaacacttaaggtttttttcctttctttttttttttaattcttccgccagctatctttaaaagcagttctaaaacttcttattttaatattgtacccattgtactttagtctaagtgatggctgcttatggccatgccctttcttctgcactttgggtgttttgtctggaattktctctcctttccttttgtgaaaaaggatgaattttccragactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccastgtctttaatttgttaatgctttcgacttaytttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtkggttcagtaaggaagaaggttttgtattttgacaattccttcatctgttaatttagtcagacgaggaaggaaacgagaaaagttattcctatttcatccatctaagactttayatcccatttcaggctgattaaaaggcaaaatcktcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctccttctgcctggagtattcttccaygtagcaccaygagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtatratgtccaactcactctaccacacagcaacataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctsagtaagtatccactggggttsggaatacaactgccctgcctcttgagcagccatgcctgcytccgaggtggtgctgmatgctattcaggaggacagaccatggatggraatcctgagccasaactccttagcctcatgacrttgggcagatgactgagcttgtctgagttacaataaayaaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacrattcagagaaatgctctgccttcttgtctatgatatcagatcaggtcagacgtaggtataagaccctgactcctgttttccaagcacttttttttttcattatgagtctatctttcggtcccctaaagcttctggtaattttttttctttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgccyaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacrccaaaatggttcttctgctcagttggtttctatagtgattttatggatataggcattttcttctcgaattaraagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgmcaataaatagttttctccgttttgtgacttatttttaattattaagaataagtgtcataragccaatactttctaacatgtgtatagtatgttatagttttcaaagtctttgacarttatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatcttttttttttttttaattgagatggggtctcactctgtcacccaggctggcgtgcattggtgggatctcagctcactgcaccctccttctcccaggttcaagtgatcctctctcctcgcctcccgagtaggagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctrcagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagagsagactactcaccaacaagaatgaatgacttagaactaaattcaacaatgtggatttatcttacagagatgatgttgagagaaaggaggaagatacagaggaatgtatcctatgtgattatagttacaatgagttsactaaaaagcaaactattcctattagaagtcagggtagaggatggatgggagcatgaagtgtcctccrtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggscagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttwaagtatacccatacccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattmcaaagaaaaacatatatatatatatawatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcrtattgtcagtctcaaascttttctgaaattggaagtgatgaagtgacagtctggctatatgtgtgtgtgtgtgkkgtgtgtgtgtgtgtgtgtgtgtgtgtgtgtgtgtgtgtgtgtgtgtgtgtgtgtgtatacctagtctagggctaggtttgggaactrttttctcccgtaagttaaactgaactagactgtatgtcaaaraagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacayaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgtagaatcsctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaatartaagatgataaggattcgtrccagggattggcaaatgacagtcattttctgtttccttaagtaaaattttattaaaatacagctccactcattcatttatatattgttcatatctaattattttcacactgcaatggtgcatagtcaaatgctttctwtctggctttttaagaagatctttgtccctcccccaccccccgccccgatttatactatggatcagcagcctaaaccctgcaaactgggtcccccatctaagagtctgcartgaaacgcgagccgacttgatgtgtctcagagtgatsattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatayagttccctattttgttttgttccrcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctrcatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatwgtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccytccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcrgcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctckctaaacattgtcacttgccaaascatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagggctgctgatccarttggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagygayagcaggaagcccagcttctctggtagcagagcasgggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaatascagtcctttcgcctgtcccctctcacrtggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcacactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattatwatattttgagacagggtcttgctttcttgcccaggaaggagtgcaatagtgtagtcatggctcactgcagccttgacctyctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttktgtgkgtckcaagktggagagaggctgtggaaacaatagagagaatagcatggaaggccacgttgcaattaaacaagattgggaaagaagacgggactaaaatcatgccttgaagatgyttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtarrtttgcttagtcattttcagagacaaaaatttgggaaaaggattgtagaatsactggcttcccaaaaccacttggtgtttacaaagttatcaaaaacgggctgggacyactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtamacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccmccmccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacakcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtrtcttttgaaaagcagaagttataaatactgatagtgtccaatttatctttttcatttgtktagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttacygctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctsttgatcaatttgaggaggatcaaaatcctgaaagtgttragcgttaccatccatgagcatgcatctctccatttatttaaggcttstttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttgagacagacatmattgctttattcaggacttctctattatatgtgatsctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaaygggaacattggccrcatcygccattgtcaattttaaataaaagatatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttyctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaagtcataatcagatagaktttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctcttyttttcctgttcttttccctctccccacaaccacttctstttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcrctgcccaggatagaggagggatgacgtgaattcacacgggcctctcctacaaatctgagtgtacatcaagtgaggggcgtccctccgcacctcactgttgggctgatcaatcccattcccmctccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaasgcttttaccatggsyaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggasaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagakgtttcccattggccacttggggtacaccccttataaatgaagtggtggcctgcaatcagtcttaytggttgcagaaagcaaccratcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtraagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcrtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggwtggggagcaggtaattatgctgggacaataggcgtatgtcaagatatctggtyaccctatctatgatctgtcacacttagtactttctaaaattctcgggcctttgcaccttctttttatcaacrcttagttctatgttactgaatatttcttaattaagtgcaggaaagaaaataaccaytttttctccttttaaagaagcacacacacctttcttttattggtattacattccttttcccwgttggtgcccctgttggttttccaaattgtcttcccatccttrtcctacctcccaatagagtacctcatcctatagtgttattataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtkcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaartgctgggattagatgcatgagccacctggcccagccagaatccttccattaataaaaggatggaccatgaactcccttttatgatatgagccgatcaaatgtgagcagaatagtatcctatttatacaatgtagtttaaaaccarcttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgaygsatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaayaatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagcccsgcaaagacgagggagcagcaagttccaaagcccrtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccstatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgmggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagastgaaactctgtctcggaaaaaaaaaaaaaagagtttaattcatgcagagctggctgtgtgggagaccagagttttattattactcaaataagtctcccccaaaactcagggatagagatttttaaggagaatttagtgagaagrgggtcagggaatggggagtattgattggtcaggtttragatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcrtcaacttagtccaaawgtagagggtcaggaaaacartgatatgagaraagggccrgttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgttttttttttttaaattaaggatgctgtatgagtcttttctcatactactgagaaagwcatacccaagactgagtaatttataaaggaaagaggtttaatggactcacaattccacatggyggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaawtaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttaytrggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgngcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggrttatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacrcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgcmggtgagtgaatgagggagtgaatgaatgagggatttgcagcttgaacgctgtactttgaaacagttccagattcatgaaatttctttttaatgcagaagatttcttatgtgaktaactgaatgggaattgatgctttgtggaatgaaatggattgagtacagagtgtgggatcaagaactwttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagrtggccctgcccttgagcaggctgtggtstgkcctggtggagagacagagaatcagttaattccagggtcatgtattaggtrgtaagatagtggttcacaccaaaaacatagaaaatgatcacttagcctgatccasaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcrattcaaaagacccctttcacgggaggctgggagatttttcyatctaaatagcttaattgttactctacagggcaatcataaatgtaaatcgacttaatatgacttgattgttagtaatgactgtscctctaatgacgctggccaatgagcctacacagaatgtcgcatgcagatcaatgagccaaatgttagcaggggactgggcatttgaagatttaaaaaaatgaaaaattgcactgtgacrttgctggttcctattagcaaaataacagacagtgttatcagtcattgactcagaagatagtttcttaccgtttggggaaagtgcttgtctattcctctccaaagccattttaaaaaaaaaattgcaccrgttctcatcccrtcatctgccttgatcaaacatttgcttattggaatcacttcgaaaaggaacttggtatcgttcacatgtgtttataactctcaaatcttcttcttccaatttttaatcttsatcaccasagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgytatcattgtgtttacagaggtggtcagattcccakcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagcsctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggtgtccsacactcaaataaacatcctttaaatacctctagatgcttataattcctgttgcagccttagtcagtgggagccactgasctgcattcgtgtaggaactgagcaaggttcatctagtctcggtagctasctaccccgagagctggctgatttttttttycttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaaggaatacatctagatcagaaatactgatatcstaagtgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttargaaaactwtttcttctttccgagacaggctgcaaaatgcttgttactattttgtgtattcctggcaggatttgtattcttagttttattactaatgataataacagttaatgttgaaatcagctycatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagastaccttyctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttttgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacrtaagcttatttacggtttgcctccttctcatgcttttggaagggaagcactgagggtcattgtatcagtcagcgtwgactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaagacaagttcttaaagtttcttccaggacgtgacasctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgacctactttttattatcagcaccrtttcatctgcaaaacacgacttttctcttcttrttacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaaygagggtattcaagtctgcaggcaaaacagagctgtttgraaagacattagcctcgaaacygcactgtgccagaatagatacagctacgtcaaaatgccgcatttattttgccattacttttcactgactaaaaccatttgctaatgaaagttctagctgmcataatttcagcacctgctgatggaaaggtggactcactggtcatggggagtacagtaaaattaggagagtaratagaatcctgaagcatttgagctgcaaaatcatagyaacaacagctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctrttgtatttacagttamagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtsagacagagaaactcacctgagcctctgtgttcagagtatttattgggtcttcgttgcgtaggtgtgattgggtgattgcccacatakttgatctcagcctccaagtcaactgataactgtggtacagtgtccctaccctaagcaatattgttggtcctttaagaatggttcatctgcaacctaaggttacatgggtgtagttaggccccaycctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcrtgaccttggctcactgcaatttctacctcccgggttcaagcrattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagacagagttttgctcttattgcccaggctggagtgcaatggcgcaatgttggtccacctcaacctctgcctcttgggttcaagtgattctcctgcctcagccttgcgagtagctgggattrcagggatgtgccaccatgccaggctaattttgtatttttagtagagacggggtttctccatgttggtcaggctggtctcaaactsccaacctcaggtgatctgcgtaactcggcctcccaaagcactgggrttacaggcttgagccactgtgcccggccatctttctttttcttcctctccttctaccttgcccaccatrgcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggayatttcactcttctatgaatcaaataatatatggctttttcctattggaaaaaattagtcktgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggcttctgtgtgggwgagtaaccattaataccttgamtaagtttataatctggtcattctgtagagcttcctatatgatgtcttctgtttaagtatttctgtaataccttatagayatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagytctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttyagctacctgggaggytaaagtgggaggatatcctgagcccaggaggtggagattgcagtgagccatgctcgtgccattgcatttcagcgtgggtgwcagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttcagggaaagaacatgacaccggcstccagcagagcctgctcttggtcyactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatsttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttktgtgtgtgtgtgkatgtgtgtgtgcgtgttatatgaagtcttgctagaatgcataaacaaacaaaaaaaatatcatactctcagatcctggatactgtggtcrcctggacttcaaaagccttttgyccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccrgctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgwaagaaattctgagaaggggtttctttgacttactggaaaaaaaaataataggaaagaaaatgtgatcagttggtatatttggctctctttcatcaacacttttatggacctgcattgcwgtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagtttyctagcagttctcttttttaagagcctcaagtgtccaataaaaagcaaatacttgaattttcagtttctatatastgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccvagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttyttccttccttccttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggacttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcrctatgcaaggcactgaggtgacaaagacaagsagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaakaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttgaccttgagaaacctatagtctaatagaggaggcacatrtaaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcytgcctgctgccatttaagacatgtgtttgctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgyggcctctggggtgaattccccccatgggaggacctggtggagttaaaacagackatatccacatcacagagagctggcccattgctcagggcctgggaagtggtagggagggaccttcccagaagagagatgactcaggctggtcccaagcccctcctgtagaacaaacagacaaggtgaggascaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagrctcacccagactctgagttaagagtttctrtgagacagagggctggactgggggagcaaggcttgcaaatcgaaagcatcagttgctacccctgagcaccatctcccataggagactctttgaacacttttttaaaaggcaagatgttggcctggcgtggtggctsacgcctgtaatcccagcactttggcaggccaaggcgggtggwtsacctaaggtcaggagttygagaccagcctgaccaacttggcaaaacccagtgtctactaaaaatacaaaaattagctgrgcatggtgtyacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacrtgaattagyccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctstcaaaaaaatttaaagaaacttagccggggccgggcacggtggctcatgctggtaatcccagcactttcggaggcctaggtgggcagatcacaaggtcaggagatggagaccatcctggctaacrtggtgaaaccccgtctctactaaaaatasaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaargaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacrcttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctasaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtgggstggggggaggggagaaggawagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccrtggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcasaattccaggacgtctcaaatttctggctggtacaccytgggyaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactraacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaactttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagcttyatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgccyagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacrtgggtactggagagtgggaggcccagtcasggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggyagccacaggagggctttagacaggacmgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgctacctggatggtgtgtttgccatcctcagtartgtgtgtcccttacagatgatgcccartgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggstactgaaatggcttagaatgccattttatcacatggtcaaattattcaatgatcaaatatcgaattattaaaaattatcaaaaggaagttccctgaaacaygaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggccsaagtttacccaattcractgcccccacccagatagaatattcatggttagaccataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctyttctagaaagcgttcttgcagttagattaacaagcagatatactgaactggtgcatgaatgaataggaaatatcccagttgcaaaggataaatctrtcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagaggrtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaagktatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgccyggtctagccgctgataggtagttactctttagtatgcccaagttcaaattacgtatgactgtgattctaacacggaagcgccctccttttctagtagcttggatgtgattkgtatggagaagcagagtgggtgcgtctttgtgtgttcttgacatagttaaagartttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccrtagctctctgggcagtgggatgggggtaaagcaaggaattaataaaaacccaccagaatacattatttcagacaatsaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtawataatgcagcagtcttggatttgtatcagatcaactttgaatgaaagcctgcctttctgcstttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcmwtttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatgsggttatcgagctttatcagagcagccttgctcttgcagtttctgacacatcaccattgatcagtcctgggaaacaaacaaaatagagggcgatggctccactctgtgtggccccgtcaatggcstggacgcagctgaaaaaatccagaagagtgtaggacrctggaaaagtagcagggtgtgcrattgcagggatgggaccagcagtaaaaggtagscctgccaagaccattaagcttcctgcarctccttctggatcccacaatttgaaggggaaatctttcccaccgcacatcactrtttggtggactaaatggctccccgatgtcccgaaagagcacagcttctggaagtgtggtatgtggtccctgagatgaagcagcagccacaggaacccatcattcctgctacccaaggcctccattgcctgrttttctgttgtcagaagagttcattttcaggtccttcaccagatattttaraagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatstacatctttcagcctctaccacattgaattggaattatwtgtctgttttatgtaccatgctgtgaactccttgaagataggagctgtcttatcttcaaggygctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacartggcaccakttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttkktttgttggcttatgttcgctgcttgrtctgactactggttttatttctaaggatttttttttaagttggcrtctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctcyarttaattttactttaattccccctacaagaatgccgagacacctctgcctattttctctttctgtgtttgttgtttcttttgtttttgttttcgagactgagtcttgstctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggctggtcttgaactcctgacctgagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcagagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaasagggactttgttcccsctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgagraaacgctctcttcttcttgcaggggagggctggcaaattcagygaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaawatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactmgctrttatttatttgttgtcactgtttgggacccctgttgctgtctcaccaaagaacttcttgtctcccttttagaagtttccagagcgtcttcctgatgttgsatagagcactcacacctaacagatctcagaacttgtatcttttctgggtggctagactgaaaaatccattttcttrtgagtgagccagaggtctgtctcttgcggcatttctgcttttgagaacctcccgtttcctgaaaggcaccagaccccaagacagctctgctgcctgattggtagrtgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcrgagagatgtggcrgagggtaggcagagagattgcaagcagggaaggatttcacgtactgccactggctttgaagatggagggggcacatggctagaaatatgrgcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccsttgtagattctgacatgtcactccacatctttgtaactttttatggctctcagccctactttcttaatagtagyagcagtatttatctactgtttattgtattccaggtaaaggatatgygaagcacttttcatgcattatttaacctagctataatactcccatttgacagatgagaggactgaggcttgtagactttccaaggctgtkcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatscttttccaatattccctcctaatctttcagttgaattayggtctttagctcaaatgcrtgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggctattaaaggaacacacacacacacayacacacacacacacacacacacgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattktctcttcttattatagtgcaaggtgtttggcagaggtgtggtagctgaaggcccaaggataacattgtccagattttcagtctttggagccataaacatccrgttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgaytggcaactgggaagcctaagggtggatctggcrtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatccacaccatrtagactgtgaggtatgaagtacctcacagtaaagaagtcatgttattgctggaaaaggggacatgggtattaaaaagacaaaaacaacagggcttcatcayagcagctatactgctccatcaatacccatcccaggagacagtggcagtcttgatgtcaatcttgttttaggatcattgccagtggaattcaggactgcggttctacccrgtaycggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccytcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccrtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctmcactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggatggttggatggttgggtggatgtatggttggatgattggatggatsatggttgagtgagtgggtggatggataggtggaaggatgaatggatgcatggctgagtggatagaaggtggatggatggagggrtggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggayaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccrcagagagaaagtgacagttgaagactatattgaattttggcccacaggaaaaggaaactttgctgttagggtcasctggaggagagactgcaggggtcagagatcagggccatatgctagagctgcartgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggycttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacamaaaaaacttttttttttagaactgttttagttkgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggmtggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttsaagcagttgtttgatttatgtatgtgaacctctccsttaggagaagaacttttctttggcaaacaccataggaacggagaccttaacaaaagaattaggactctcttgtcctgttttaatctsaaagctgtccctgcgctggtgcggctggcccacttgtgcctttgtgaatttgcagagaagaggctgggcgtggggggacacatgactaatccgscctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatgktgccttgcagtttccaaagtaagctgaacagtgttttytaacagtgctgcccctctctcccactagaaatgcgagtccatccttttaccaagtgtggtacracaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccawagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtytggagggaacagagagccatcagggacaataggtccctgtgccatcagctactgggatgtatgacttyccagtagaggtacacagmacttgttccaaaaggagcctatgtagctttgggagttctctatttagtcaccttattttttttgtcttcttgttaaactagcatcctgttttactgaatctctgcctcmgttgctttatttactgtatacatacatagctcttttgaagacttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacrtgcctaaattgatgtagttctctgtaaaactagttggtgtaaggaaacttggtctttgaccatcaaggaggttgcagtttgtggcatggcacaaagataacactcagcagatayatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggaygggtgagtaaggggggataaatgaaaggcttgttyttctgaagggactctttacaaagagtctttsatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgycaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctrtcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtrtgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatcttaacttgaatcgtrtctcccagarttcccacgtgttgtgggagggacccagggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaasatatctgaaaatgtsgaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgmctcttgttwtgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgayagaaaagaaraacccattttctggggagaaattcaagctggctgcagaaatttgkgtaagtggcaaggaacctaatgttaatstcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaakgtatagctcaggctgtggcttcagagggtggaagccccaagccttggcagcctccatgtggtgttgagtgtgtgggggcacagaagtcaagaattggggtttgggaacctcygcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtkaggagttcgagacyagcctggtcaacatggtgaaacccyatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccayaatattataggcttttcatgtacatcgtttttaagatggctrtaaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatasttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcaractattcaaatgcttcctttggtccattgttgtcctttcttttctcttctagaactttccccatagtsatgcatctgtccctgggttatctgatatgtgtttcagcctgttttcccaagtttacctgcctctytgagragcccatcagccctgagagatacctggaaggaaagaggaaaatgcskgattcaaatcatgttgcaagtggatgaatytagccccaaacaactgggaggcaactactcctgcctgccgaggccttttttttttttttttttttttgagactcactctgtcacccaggctggagtgcagtggcatgatcatggctcactgcagcctcccgggctcaagctttccacccmcctcagcctcctgagttgctgggaccacaagtatgcaccaacrtgcctggttaatttttgtggttttttttttttttttttttttcctgctgagatggggatttcaccatgttctccaggctgktttcaaactcctgagtccaggtgatccacccatcttggcctcccagagtgctgggattacaggtgtgagccaytatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagctggagactgcagaggatggcacagagttccaaatmtttggggtgtgtaagagtaggagaggcaggatgggaraggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcrtggtccgcgtggcacagcgcgtggtccgygtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccrtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcartcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggcyccagtggccsttgtcttgttatttcctccattagagacctggcrtataattgtgggagggagaagccagtggagcagtcaggggactccctggctgtttctgtgtctggtcttatgggtctgggcaytgaattcartcacaaaccctagcatgctcctttgctacctcaggggacaaagtcaagaaaataacactaggattgccaccctgctctctctstctctctctttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtrctaatcaaaaaagccagtcacaaaggaccctatgttatatgatttcatttacatgaaataccccaaagaggcaaatctrcagaaacagaaagtagagtggttkccaggggctggggatggggygtggatggaggcatttgggattaacagctaaagatagcaggattccttctaaagcaataaaaatgttgtaaagttgattgtggaaattctttcacaactctttgattgtastaaaactttgaacactttaaatgggtgaattgtatggtatatgaatcatatctcaacaaagctgttaaaaaattgtatgaaaactgtgatgggattcaagtagtstaaygctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactytctctagttcactgtgaatggttttygaataacatcaattascataacctcatgcccagcatsgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgcccyggccttctttttgtrctgttgggttccaaactttacctgaggattttcacatgcacatctgttaaatgccatttaaagagaacactaacaagagaaagctagttcatttytcttcctgggacctcagtttcctcatyagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtsagcgccrtgtatttcaaagcaggatcttaatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggragggtgaagagtagcaaatttaccgtcatcagcaggtgtstarwtgttccatttamattgaatggcacatgtcataaagtacataccgctgcacatcccaccctctgtttctgtttcaactgcagagcctatttttctttcccttccagctcagctgccttctcctccctgacytcaggtcacccaagactcccactttatkatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagrccygtaattgattcataagatcccttcctccgatcgcattgaagagttaattatttttcctgcagttgggactcagctgttgtttccmctgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttwttttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaraagtaaatgaaaartatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggrgaattttgtgtgtcacatcaataaacatcttaattgaacagyacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattkcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcrtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccrtaaggacccttgccattaggascaaacctcttccagctttctcagcagccacatgtcaccccctcttccaccctttgccctgccaccctccatcccctgataycctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgwatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcarstgtttgttttgaaccacttattttggcaagacttcttcagacaggagagccctgagagctcttcaaaggctgggcctgatggtgtttgtcagagaggttyragctcttaaatttaaatggcctcccacagggaagcagaagtccttttggatcctccagaggmctgagatcctccagatsctgttcatttgccttattcgttatgaccatagaagtttgtggggtggcactctttattctgtcctcgccccrcaagcaaagcacacaccasaagctrtaaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttytaaaaaattgaggtgaaattcacataatataagattaaccatttcaaagtagacagttcaatagcagtacattcacaatggtgtgtaaatacygcatctatctatttccaaaatatttgtatctccccacaataaaagtctgtaccaattaagcagctactacccattcctcttccctaccattctaccttctgtctcagtaggtttgcytatttgggatattttatttaagtgsgatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatsgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatcyaaaccttatcaccagcgcttgttatttcytcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctygaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaatcagctagcgatggctaaggctcctgtgasggtttctacagaggttccacccagagaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgcatttatccaaagggtgtgattggtaagtgtgggtastgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccagstgcttgggaagctgaggmaggagaatcacttgaactcagaaggccaaggttgtagtaagctgagattgcaccactgcactgcagccttggcaacagagcgagactccmtctcaaatcartcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatttctctgygctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtctwgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaatyatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtrtctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattcttyttttttttttttttttttttttgtgagatggagtcttgctctgttacccaggctggagtgcagtggygcagtctcagctgactgcaagctcygcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggsattacaggcatgagccatcgcgcccggccagagggctattctttgtcttttatttgctttgagtcyggtataaccatgtggcacatacccctgtacatgtttgccaagactgctatatggyagagcttggaattcttaggagctttatcaggtaattgcaagtcccccacctcyaasaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaatascgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgyggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaaaaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggawgatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtackctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggakgcrcaagagactccttttgactgcaaggactcagtaaaacaaagtatttcaaggtcatgctacaaaaagtcccaccaagagcatggtcaggaggtacagtgcacttacccacacggakcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtamtttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaaaactctgtctcaaaaaaawtaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaasttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaaggtttcattttgcttcavgaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccakctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctratgcagtcaaaccaccctgcagaatcttaacagcaccacaaatattrcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccrgaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtktgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcasgagttcgaggctagcctgggcaacacggcaaagscctcatctctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagrgtccggagctactaaaggtcaacagctgtgttaytgcaaactctgtggcctgcattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatyccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggyaacttgttttcactccctcagaacctcagtttcctttcctatayaacgcaagccataaggttaacccctcctcgtggtgatgttaagatgaaacaggraggtgaggggcttaacacatttccstgttcccataagctttcaggagatcttggtagttttcatctcggtsttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacaygcatgcattaattcgttcattcttggaatctacmcacctgtgatgtgctagttactaaagatgyagcaatgartgaaaggtaatcctgtccttgaggcattcacaggtaaagaagcctgcttgggacattgggccgtgagctccaacratgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggrgaattgcttgaayccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgrttcgtaccagctccccatcccttcccaygatcccatcttaatgtctgttgtggaagttggcccacagaagcctcaagsctaaccaacaagaaagatcacttcatatgcattagctggaaggtarcaagaggaaatcgcctgccagggtccctgactcccggaggaaagtgtcctctgagccctccttgagggacataaatagccycaaaagtcactgaatgctaagttggctttctccccaaaccttctaagtaggcartcaggatttaacgacccgcaaatttccaattttttagtttatgaaaaaatatatctacrtataatttttgcctccattagagtctcatctttaaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccraggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttmagcagggctgccaggtgtgataaatgactaatcagcacgcaggagcctcagtcctcaaaggaggactattacagtgttatcagctgcgggcctgggtgtacggagcccsgaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcgkggtgcagcttggatggcatcrgaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatkatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgygaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttctttttttttttttttttttgkttttcctcccagcctctctcctttcccattatgcacaatgcgctgagaaaggattcccagtccccctggtaaaaagtctgraggatgccgaggagttcactgtgcccttagataataacagtttgtcttggctctgatcacycctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgccccttgcccaattccctcccctctcctgcstacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagacmmcttttcagctgggtgctccctggaagatggatcttgccttgtggatgtttttctaccgtgacagaagatagaaaggatgaaatagaaagagtgtgagtgaattctgcacccaccmccvccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacayatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcstggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaakgtggaaacaagcsttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcstgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgcmatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcrttgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatscttcatgtgtctgagcaggcytcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaacsgaggccggttagagacaggctggcagctttgcctyctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagayttcaaattgagcyagacctcaggcatgaagggaggggagagagggggraatgtggaggaagggggcgtttgtgcagkgggaagttggagaaagtacaaatgaaagcctctctgcagtgaacctcatgactgctttagagaggtgcttatgtaataactgcagtggtrtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgyaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcaccyggcccctgcstttttattttgctaaacctgatgacccttgccatagcagaactaaagtgatgatgatgattacagcagatcarttattttgagctctgastttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtatmccgggaacagaacatatatggkttcatttcatcctcccattatcaccgtgaggcctcttccgcttatctatkgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagrgtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacytggccaacacaccatgccttcccagtctctggtgttactstctgcataytgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcrtttagagctcccctcttgtgtttcagaaaggaggagttgttgttttcttttcacttgagtttaataaatgaaaaaggggaagggagagggaargaagaggaaaaagcacaaatgtgcttgtttttggatsagcccctstactgggcacatggatgcagtcagtcctcartgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccraagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcastcagcagaactgtaytttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctrtgtcttcartgttsttcttatarggacaccagtccttggatttagagyccaccctaattcactgtaatcacatcttacctaagtccatctgcaaagaccctatttccaaataaggtcacattctgaggccctgggkggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccrctttaaggacctttgtgatagttttgcacccactggatgacccagaatcatcttcctcttttaagatcagctgattagcaacgtcagttccacccacaatcytcatttccctttgtygcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactrttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactktgcatgcaaatgattcctcataacaaccttgggaggtagttactttcattgtrttagctatctcttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacmgttgcygcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgcycccracaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagkggrccccgatcaggtggcagggcctttaattggagccacgtktgtataatgagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttrtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctrtggctcttttycacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttgkccagccttgycttgaactcctgacctcaggtgatccacccacctcagcttcccaaagtgctgggawtacaggtgtgagccaccgctcctggcacccatcaaattttcaaaggaagaaatggaatggtgcaaccatggtacatgggaaggaggagggggacacacaagactgtrcctatcatgggggcttcgacctcatstgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaycgagcatctgctgtgtgccagacaagagtgaggagctggggactcagagaggagcagacgagggrgacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacacttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcratctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcartttgaagakccacatatggctgagggctactctawtgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctgrtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgmctgggtcccgkgtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgyctgcatttcgtcgctttarcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctrttccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgayttgccattgggttggagtacttctcctgagtttctgcagtgttctaggtatggtcttaggccctggarwaagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttmagagttaacctgagtgtctgctgcatagtaggtgctcaataaastataacstctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacakgtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatrtttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcrwaatagaataaaatasacatttgcacaccacagtatccaaaaaggttatgtactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctsattaattgaatcagtggtttgggggagtgggstgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcamccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctrttccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagraaaaraaaaaagttggaatgacatcagactcaaaatgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggacmgccatcatatatgyagtctgtcattgactgaaagttgtcatgtagcccatgactrtcgtctcttttaggggaaaaaacaaaagcagaaagcaagcaagctggtatcckgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacamctactacatgctaratctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcayggaccccttgggcatttggtgccctttgcasaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacmtagtaagtgctggataaatgatagggattsatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaagggsctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagygctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctwtaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgygatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagycaggaaggtgggcttgttttgttttgtdwtgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaayataccctttaatgattttctccatggcctttctgataatcctttcatccttcatctcccctgtygccsttttctttgctttgctttgcttgctttttttkytttttttttktgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagrggcccttttcagccctgttgacacttcccttctctgtgctttagtcaccctaccctcggtcaactcctaactcctgcctgccacagggcctttgcacatcctctgccggggaggctctccyttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcgtcccaagtagctgggagtacaggcgactgccaccacgcccggctaatttttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggagratcmcgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccrcgcccgrctgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggaytttggaaatggaacaggatgctcctttaagttagggtaaaatgaagtctatraaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacscgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccakctgggtttcccatccctgcagagcccacgtgtggggtgctgagrggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatatctgtatacagatatctatatatatagatatctatatatayagatatctgtatacagatatctgtatatatatatagaaagagagggaactgaacgggatgctttttattttgggctgttattaggtagactctcctgggacattctacacagctcctgcctccttctgtatgtaayatatatattatatatatataaaatatatattakgtatagataatttatatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatrtagactctaatatgtagtctatatattatattataatgtatgtaatatatratatattctatgtaatatataatatattctatgtaatatatattaatatgtagggaatatgttacrtattatgttgaragtgtatatrttatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatwcacacacacacacacatttcaactttcttgaactcctgaaccagccttagattgcctagtaccagggttcttctttttttaaaaaatttatattttattttaagttcaggggtmcatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacmtatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcarccaccattctcccctactttgtctatgaattcgactactcttggtacctyatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatmcttctctgatcagagcatacctgccrtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaamaaataaatatctgtgatctcatcrtttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgayctcaggtgtwccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtgkttattcccagaaagatccagtgaattgtctcctgaagawaaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattragatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtsttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaagtcccacatctcaggtacatttcagttcattctttctgagttgattttttttttttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatsagccactgggcctggcctgagttgataatttttrtcatttmtttctyacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaamctgacactcttagaccttcttctgagtgctttgtccttgtccggasagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacargtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaamcctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcckggagctgggtttcttgcctgatcaatgtatatcattttgccaagagacagagtctgygctggagagattgattccctggttatttatcttcctctgcccagtgtaaattggtcagcctgatcctattcgcatgataaaaatcataatgtctmaaattacttactcaataaaatgtgggtttgtctattattagtgattattagggttataatgcagcrtggaaatttggagcaaattawctatacatgcaagctgttgggctcaagtgcagttaatcatacgcatacagtgccagtgggcagaaggttttgcaagaatagcttcaggaagactttgtgggaagacagatgaatactcagggttttttttttttttttcttctaayttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtgatgcrtcagaatttcatgatgagcaaatgcctrtggatgccctcatttctcatccttcttgactgtctgctaagattcactcttggtcttgtstttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgawactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggyggtctgatayagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacrtacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaragacacaaattgtccttaccctcatggattcaccatstatttaamggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgattttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctstaccaccatccccagagtgacctccagaactgtaagggacccccgcctttggtacagagatgggagttaaacacaggtgtccactggagtcatgattsctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactgggrcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgcygcctttaggaaacgagatgaattgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtcmacattagtgaacagccaggcagtcgctgcctcamatttctttagkgttatcctttcatkccagcaattgaatttgatttgcactgtttcacttctctacaagggtgtaaaaagtagaggttcctcttsaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcasccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatcsatgtccctacaaaggacatgaactcatccttttttatggctgcatagtattccatggtgtatatgtgccagccatcccgttactgggtgtatacccaaaggactataaatctttctgctrtaaagacacatgcacacrtatgtttattgcggcattattcacaatagcaaagacttggaaccaacccaaatgtccaacagtrrtagactggattaagaaaatgtggcctttgcctcttttaaaaagttctaagttgctagccagtcggracaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagyatttctaacaatcatattgcttaagaagtggatggcargaagataattactaatatgtctgcaatygatctgaaattgacacagttgatctmwctgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttyacaatattagaggtaaaacatgaactsaacgcttttaggaaraaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggyaggaagagtttgccagyccgaaaactccagtaagcaaacagctttatagyaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacayctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttcyactgactaatcaggctgataaaacaacctgaaaatggctttcccatggagtttatatatttcgtcagagacctaaaatggtataaatgttcaatartagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcrgaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatmttctctttatggatttccctttggaagcagggataagaagagrgaaggtctcccagatgtaaatttctcataaatatttgagctccatttcagtaattcyttcattctctgatctsttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggatrattytttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtyattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcktgtgataggttcaattctcaggctccttctcrtyagagtctttctgtaaagaccattattattkctgttatatttcctgtggctgagctgagccrcacttggagatttgatccattttaactctctcattgccttcagagagttggtgattttggggggggcaccagtktgagtcctttgatccttgaatgacaatttggatttgtctcaaggtcctgmtaaatgggaactggaggaactggcctactatggtattacaggctagcacatggtttgcattctgagggagctcagaataggyaaggtagaagacataggtggtcaagaatttagaaagacccggactcgaatcccagctctgatccatctcagctctgccatattgccaagttccgctgagrctccatttactcacctgttgtatcatctgaattatttycatatccataatgtgcaaggatatccttccatgttattagaaatacagatacaccatcattatcastggccaaatcattmaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaamaaaaaacaaacaaacaaaaaaaaaaaactccttcttcatttgttatagttccaggatagagtgtgtacctgkatagagagagtcaggcagatayaggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatrcttttgaattgtgtgattattgttgttaccatttattraaagggaatgatgaatgtagtgagagaaggaaggaagagagagagggaagaaggggaaaaagagggatggaaaggaggaaggaaggaaaggagggaggaggcaagtatawtagtcatgatatakggaattgaaaagacattcacrttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgaytattatasagatttatggcttcttgtcaataatactctgatttctggagattgttatcagtcataagctttataggaaatatctcctwttgamaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgrcacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcstcagcctgcctcccaagtagstgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttgscaattccttattgaatagattccattttattttatttacattttgtacaaagctgataaataactgaaaccaaattagctcaaactgrttatatttctgggtacaaaccagrtgtatagttaatccattgttgtttctgtgtcraccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgccygtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttastccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaasaagcacagagaggctaaggaatatgctgaagcttgcacagctagtaaatggcagaacattcagactggaattcagacktatacactcayattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctmaaatgttargaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaarctgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagaygctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaasgcctttcaaagttgaggacacttcccggtgccgtgcggtgtaaatcacagtgcaaactatgcgattatcccctgcwgaggaatcgastgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccmyttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagyttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcmgacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccwcttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacawggaatagtactaatacttcatgctcatcctctgcctgccctgggtttttaatttgtgcgtgtgggtggggtggggggygggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattastgaggactttgtggttcgaatggaatgagtgtgytgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtsaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccaygcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgttgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaartggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcvtcactcagcacagaacattttgacaatacacttccagggcaggtggtttcttamtatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctgtacatttccaggctagyagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattattwctgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacrctgctgagtgtctycaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagraaaaaaaaagcctttcaccatggttagttcgagaagcacagcaatacagtacttctgctacgagtgtatacaggctgaggrtgggtsctttgtggcccttttcttttaccggctgactagaatgttgacgttaaagcagttagagtycgagcaggcaactccgaccccaagttggagmtgtgtgttgaagatagaagagcaaatatgtrgaaggaacctggatttctatttttttwaaaaatataataaatcatccagccccaaatgtcaggaacctgggtttctaatgatggttggctgtcacccccatttcccacactttaaatgagagaagtaaacatctgacttcctaaaaccaccgttstcactcaaagccgaatctcatcctgactgaaatgtcactagtccttttttttttttttttttttttttttttttttggkcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcagtgaccccaaagaccccagagaaactcagtrtgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaacyattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacaygcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtcccccctttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctstgcaaggatcgttcactmgtgttctgcaycgttcttcttactcaactctcccgagaggcattgtggacgcctgtggggttggtttttggcacccatycctgaccccttcttctccaggaaactctsttcctayctgctcctcttgtggctaccttgggaggtgccatttttatcaaggttagtgtgtggttaagcaccttsccacaagctcaggggaaaaaaaggtcccctccccagattttttttagaactggaagtttccatttcctggcactgstgaaagctctaggacataaaacttgggagccgatggccttcaggctgcccayaatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccrtgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatgkcttcacttctcttggcctttatttctccaagtggtgataatgagacctatccctaacggttaaagtgacatggtccatttaaagtgcttaaaccaattgccaggcacataataggtgctcaataaatacttcstttatttccctgttaggcctctcccaaccagagatcraagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccramaaaaaaaaatatgacagaagtrtcacccatccagccagccagccatcaatccrgtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccwtctgaaactttccttaaatgttcggctttgacctgtcattcactaagtctttcaccatccttcactcatcttacctccttcttctgtggcatttcataaatttaatgattgtaattgtgattacarcataattgtttrtgtctaccccaggctttgcawcagggaactatatcattattttgcagacacaacaaattctgcaagcatgtatctttggaataarggagagagggttggacacraatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttamgatrccacgcactgctttaggcactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggrtaccagagaatcccgtggaatcccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatmgaattcaattcttctcttgccacamatcagctgtttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttgrctcactgcaacttctgcctcccgtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcscgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttyagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgayacttccagatggaaatattaagagccagtgtgtggttcaccctgaccccttcctatgccccagcaattaaggaagcaatgttcagatgaaacccatgtcttcctcctgggtycctgagtgaccacagtcaacrgagcttccctgttggccattastaatgtcaagaacaaagctgtgtaaagtcactaagattttggaggtatcggctgttgcagtagaacctagcytatctcaccygacacaaacgttttctttctcacaaaacctcacaccagtgttgttttattcatctgcttatgcacgcgtatggctgcaacatccttccaaaatgcattacaggctctaatgcacgataagacarttaggttcgaaggaaaacaaagacaattgcacggcacagagggaatatactgctayggtaaacygatcactaacayccggccctgaatttgcttmaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtrgctgagaaaccagggagaaacaggaaggagctgattgaggagaccaaaggagggtggggccgcagctctcargcactcttggtgttcagaargccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttyttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcrcagtgactccttgttagggwttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacggragtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttascaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcawgactctgtgctggacmaraagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcrttcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcayagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctmcatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaagacgatgctgtatggctctasacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggsgaaacccctttttccagtaaaagtcgttggcgrggagtgaattgtgatggaracagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatygcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctmacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgattttcccacctcagcctccctagtagctgggactacaggcatgcgctgccacacccggataattttttttttttttttttttttggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcawtggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctsctttatttttctccatattatcattgccatcaatccaagcacaatttccagytacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattygtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcagrttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctrttgattttgaccattgcatcttgcctcacatctgaacttcargtgaagtttcaaaccaccaggcaacatgcattacaggcaaaatgataagtcaggtcctgccgggtgactaaggcagtgtggcaaygcttcaagcctttaaaaccatatcccagtggccccaaagcattaataygtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaamggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccaracacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagsgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcagggggstgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaasgatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcckgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcrtcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcytgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaaccyttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttytacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgcyattactgttatttcataagacacatcattttccttcaaaattamaatgaaaactcataagcatacatcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgygtacttgcaatccccacttgascaaagstgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttyacaaaagtggaaaatgtgatatgacagactggawccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacmtgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtwctaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaagagagagccgggcaggttggttttaaattcaargatttatgttgttaatcctccgggctaattataatttatgggatcttggcaaattaatatgcagttgctattcaaaagtggagagcaatgtaargcaggcataaacaagccttgttcatttttaatttatttccaccaatggagaatattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaargcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagytgggtgttgggcaagttagctgacttttgtgagttttctcatcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcasatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaayatttgcaatattagggacatgctaatacaattattcattgtatatgttaattcaaattaaatggaatgtcctatattttatagggcaaacttaggcttacgcytgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaaytagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagwgtgatatgagagtatatgcatggagaatattttctgagstggtgatgagctgcagggggcctctcccagcccccgcactggttgcacttttaaataagagaaaaaaacartgataggactgacctgcgygtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatayaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtagrtctcgacastgggcataaattattcagtaaatcatgccataaatagacgtggtctcatccagggtttgttattccatttatagagcacagggagagtaggtttrgcataattcttaaggaccctaggattttgggaatggtaaatgagcttggcttcaacttgaagtcaccagcagggaagagagtcagcctgtgcttcgmagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattgsaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccaygtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctrtagttcccattatgtctttaggatagattcccagaaatggaattactaggtcaaaggttgsgcacattttttaaaggtttgtgagacatattgccaaattgctctccaaaaggtttgtagcaatttaaatgatcagaagcagcactgaagtccaktttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcsctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacaycctgccrttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttasggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgagggcagytggggagtgaatctgtcgtttgttgagrctctttttcctgcttgccagacactgatctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagagaagtataagtaattattatgctttttwaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttayacccgaagtgcattccatggccctgtcccagccatagaaagaaatgcctttatttttaagcgagacttcttgtggaatgatgaatatgttcagggaggctgttgrtggcaagaaaagaagggtgatgggttgggcttatattgtttagtggagcaaaasagatgtgaaacatttgtgtcttaaagtgttttggtcargagaaactaaattggttagaaagtgtgcaattttgcaagctttataaaartataaaccaatgagtctggactctgttccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattctggatgatgtgatggggaaagaggatgtgagctgagscttggaaccaagcagagcttgggctttggggtgctgggaggacagaatgctggaaacagaggtaagaagggtragcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccmtgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatktagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatggagcaggggagatgctgatgatttggttacccscttctccatcccccaccacccaytgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaagktttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggygccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcaggrcctaggattgsaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaamatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggartttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccarccgaagagaccactgcattgttggccataartgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactscatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacacacacacacacmccccttcctacgtcctacatccctgtacttggaaagcaatcatatttaaatcattgctgctggaactttagttgactttataagttacattttacataaaaaggcagcagtggtgaagctggaagagggcacctagrctttgatttcaggcaagattttgttaggtcccagtattggracttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactakgacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctrctgtccttgccsgtggcctgcactggggagttgtatattgtatcagtaattttaaaagccagcaagtgttctaccagctgaagaagttttcctaatggtggctggtcaaacgtattacttaactaggcgtatagaattgrggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttayagacatgtcatgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacarataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccrtaattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgakagctctgtgtaaattaaggaaaccatcaccaccttcraatggctgactattgtaaatattttaatgtttgtcgtttgtttgcaaccttgtaattttttcctgtgcagcaattttaactttctatattcaaatatactctgaatgcacagtgartttggcagaataccatttaagtcttgtattttccaaagytagtcaayrtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccytggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttyttaggctaatttctgtgaaattgtgattgggaggaaaaagtgaacaggaacttaaagccagcagaggaaagctacctgcccttsactggtggtcagtgcatggattccagagacagggtgggcaccagttcctcacygggtcctttctagttgcatgacctggggcaggtgactttatgtggctaagcctcagcttcctgacatatggcrggagtaataatatcccttgaagccaacaaaattcaataggcacatgccatgtacatgcctgtgttatgccgggaacttcttaacatttccagaatatgtgtaatcatatttgttacatgcwatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagyctccagagggtgagactgacatctcatttctctttkcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcastgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatygaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagmgtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcamccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccrtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccmcggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtmtttcttgaattttaactgtgcctgaagatcartcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttawttacagttttggtttccaaggtttcagttatacattgtcamctgtggtacaaatatattacttacaataygatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggwcttggagtatatcccctgtgcagaagcggaggctactgtayatamatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccrcatccagcccacaartattattccaaactgtaaaatcgtgaaatgttttscattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatayacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaascttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattstgcaatatcacagtgttgacacttacagaatctatggatcttattcagatttctcattttacctgtactcaagtgtgtatatgtgtgtctgtgtctacatatgtagttttatacagtgtcatcaaatrtgtagcttcctttatacacaactacatcaagacagtgaacagtgcatcaccacaaaattccsttgcgttgccttgcaaaccacacccaccttccttctgcscctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtctatgtctaycagaagccttgctgcagttttaatggggtttaaatstataggtctaacrttaaacctatagatcaattcgggagaattgacatctttactrtgttgagtcttccagtttgtggacatggtatgtaattctatttatttagtataaacccactggagtgtgtacctaagcatttcattttctttggagcgattgtaaatggcattgtgtttttaattccaacttcyacatatatctagaaatatgattgagttttgtgtgttgatcttgatcctatgascttgctgattgcatttattataaagttccaggagttttttatttttgtttgtatttgttagtttttttgagatttcttgggattttctatctagcctgtcatgtcatatgcaaatagagaattttatttcttcytttrtaatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatawgattttcctttagctttttgrtatggtggactatattgattttaaatattgaaccagccttgaagacctggaataaatcccacttgstcatggcatatatgtttttttatacattgttggatacagtttgctaacattttgtggatagctcaccracttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaakackttcttctctgattaggcctctcattttaaggcagttgagaagactcacagatgtgattcactggcaatggctctggttcaccaagsttagctctgctcagtctacctttagcagaagattaaaaatgaaaactcttcttgttagaggtagaagagatcctttcccaaaccatagattcatggaactgtcaamgagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattattgacgtccagctgartgttgccacgtggaaattagctataaacttgccagaacctccartttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccasttggagtgagccaaataaaatacatcygcagtccagattcaacctgcaggccatcattctgctgtcaytggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatacyaaagaggaaacacaaatttgactcatttccccagaaaattcccctcctgctttccatatgttatatagttaactgtaaaagtggcaccacctcttaaacagccagctattctgatcatttgaaatctggaacattstttcctacggtggttgacttttcactgcctttgaggttctttccaagtaaaggcgttatyctttgtggtgtgctccyggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggygacaragctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaawccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatsttaccatatyccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagasaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgwgagtgtcagggaagcttgctgggggaaayacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtartggcttgcgaaaagattccagcactaaagtttgaccccagtcctacctgacttcctttctccagctgtgagactcccctgtacaatttttctggagggtctagagtcacatgagtcacgccaagccgccctttcagtgygaaggaakccaagcagagccctcctctgctgtgggtacttacttagggaactgtggaggtgtcctcaggtagccactggtgtgtggggtcataccaagtcatttggtttacatcgggaatgccttttgtcrttatgtctagacccctggagaacagcccacrgcaatgcacttstggaaattcggactgtgrattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagsgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagkatttgtgtaagtgtcctctgccctggacaccrgtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatastggcccctcatttcacttcctcagctaaatctacctctcaaagatagacatggacatataaataattttttaaaatcctcttttgcaaaaaaaaaaaaaaaaagaggtgaatttagttgaaaggatatagccaywcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttmtagattctacagcaggcactggcaagcttttgcttaagaaggcaagccgggaatggtggctcacgcctgtaatcccagcwctttgggasgmcgaggcaggcagatcatgaagtcaagagrwggaaacyattctggccaacatggtgaaaccccatctctcctaaaaatacaaaaattagctgggcatggtggcgtgtgcctgtagttccagcyastcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcasttttagatcgtagaccataaaaaaacagcaggaaaaactasatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgycttataccagtggtgcctagcrtggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaaggtctcactctgttgcccaggctggagtgcagtggtacaatttcrgctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggasgcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaamtatkaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacaachccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagwctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatkccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtayagacatccctggtccacagagccaccaagcaaggcagactatttcgtgagaaagaaggaagatagactccatgcaacacagtgggtgtggcaccaagcgggaggtggagggttgctacctastcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcatttattctttytttgaagagstatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagraggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcartccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcasaccagagttacgtgcacaggttgtaatactctctcttgtccctggttgcctgattcaagttaggggyttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcrgagaccttagggacaggacaataaagatcaggccttgggagatgcaaacagtttgcccttggaccatgtcttctgctttcatccttatgctctcaacagatcatgccaaggtcctgtgttcmccgcsttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctmatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctggrcaacgagcaaaactccmcctcaaaaaaaaaaaaagagagagagagaataaggtcagagggggaaaagagagaaagtgaaagcaacagtaaggaagagaattggaaaaaaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcrttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctgratgccccaccactaccamgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgccygcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtatatgttacmgagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaayagaatcagagcaaattcagcatagacctccttgggatgtttwttctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaastagcacacaaacccagtccatsatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaarttaatgtcattttyataactatctgcatttcaggtacagtgatctcctttaaaaaggctgcgtcccagcagcatagaccarctttacctcccagcgtagtcttcagacaagttrgggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagaytgtgttttaaatccttcttagtttgcagcttttyttcccttttgcctcctctttagttcattccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactrtgtcaggtagacttatttttcgagttgtgctggttaactgcaatccaagtttaggaagcaaactaccaatttcayttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctaytctctgcaacctccacctcccaggttcaaacaattctcatgcgtcagcctcctgagtagctgtgattacaggtgtgtgctaccacggcmggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacarttaaccattttaaagtgtacasttcrgtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccrttcacttagcatgctgtttccaaggcttgtctaagttgtggcatgtgtcagtactttattcttttttatggctgcrtagtattccactgcatggatataccacatcttgtttatcygttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgaygaacwgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccagkcttgggtgctctcctgcagggcattgcaatctttaggacaccttcattacccctcctaaaaggagattttataatgagcgccaaccagctcwaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcwatacaactgttaagaccacttaatgttatctttgrattaaaaatggtaccactctcataaatcaatgagtttcataccctaaattatgccagattaagaaaatgaaatctgactgtaaattacttctctaggagcaaatgattgcttgattctattgtagamaataaaaattttttacytaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtsatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacrtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaartaagtaaataaatgcctctgtgaatccatytcattgcattggaaagacctccaggattctctscagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatamaaaaattagccaggcgtggtggcgcatgcctataatcccagctactctgggcctraggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacayatcctgctccccactcccctaattactcatgattscactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcatgtcrttaaactttgaatctayggacatgtctttttctttctggcatagtttggaggtcttcattttrtgatwgaatacaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttmtgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctcygtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttrttcttttacaaaaagggtcagcagactttctgaaaagggacagatagtaaatattttaggctttgtggaccatagggcctgtgtcaaaagtactmawtgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgrtgacttctygctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgccyrgctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgsgatgtgcmtacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacatamaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactawtgcartatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagrtcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctrtccgttaacaggtttatttcttcatcagatattaattccagagggtttcacccattataaaatggacataaagcctggggtggtgatggtgctgcctctgtaacyaggctcagctgtgtgtcttcgtgagcctccttgtggaccctcaaatgtgggaaggakataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccrtgcaaacatgcagattatacatgcactataggagtggaatgtatgtgayttaatagcgtaatattttgtccattattttaaaacttgctttatttggtcaagacatacggaacacgtatagatcaaacaaaaattttkaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaartttgcttaacatcccccttattactsagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcstgcaarcaatcccactgcaggtttaggctgcatgtttcatccatttgcagctgtagcattttacaaaccacagcataaaccctaggaataattctgttccccactgkgatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaggggaaccttccaacatccccaccctacccaaaggatgattcctgctcacaccagccagctggagacattagagcattacttctcggtggcaagggagggactcttgttctttctggtggttcgttttcaycttcaggtcatgccctgtgtcacctgactcaggcaccattagcatctggggctgtacacgtctttgtactgcacactgtagggtatccaggattcctggccctgcccsatgatataccagcgccatgttgtcatcaaaacraccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcrttgtgctaatttactgtattcttactctccctctccagtgctgtgagtaaatcagtgtgttccttatacttaataacatactaagtggcaataataattattataacaaatgtatcaaataactatgtgtgaactctgcrtgtttcagcccatttaatacccattacctacggaggtggtttctactattgcacccactctacagatgagaaaatggaggcacaaaaagttaaatcatctgccctaggtccsagagctggaatttgaaccaaaggttctgtgcctcccaaatttgtattcttatctctgcatcacactaacwctgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgcccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatkattcaacctataacaagtaatactagtaatcatctcactcctgtaaacagtacagttgccatacctcaagtatctagtatacttgggacattagtctgggaatttttctccartcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacascscacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccrggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtsttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgstgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaayttgtstgctagaaacctasggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacrcagttgttacctgctcccgktggragggrggggatatttatttggcatcttgcaattgataggagctgagtgattttagtaggtagtttaactccttaaaaacttccagtggtttcatattctacctagttttaggtgacagctggtatggggtggggaagsrgggggggataaagatattaatttggaagcatttgattgctccattattttatcatcttcccatggaaatgttttcataacgysttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgyagctattaggcgtagattcctgcctaaggtctggatatgaattccaaagaccactggactttggaatattcrtargtctctgaaaattcagacccacagaggccttaccccgctacagagaggccccargagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctraaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaattttttttgtattttagcagagacagggtttcaccgtgttgcccaggctggtctcgaactcctgagctcaggcartctgcccgcctctgcctcccaaagtgctgggatcacaggcgtgagccascgcgcccagcccatgacttctcttyatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatyactgatgaycatttgagacataatttggagaaggtttctatcaaatcctagytggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctagggsatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgytcctgccagctctaatarggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacscatcccktttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgysaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagycagcaaagaccccaggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcytggcccatatgagatctcggctccracgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagagrwgaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtrcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctsttagtggggacawtaatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctrttcrgacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcrgtgtcaccctgagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggmcaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctatsatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctytcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactgscaagtgcctctgtgctgataytgtacctgggctcagtggtctggctaaaggagaggtgctggggccaggtgacaggcgagtctctatayggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctyagtggyttgtcataggtgtcaaagacaggagtccartgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctattcagctttaaagagtttgagagmgttttttcccctctgttaacaaacgasttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgasacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaamagcttgtttgtggttygtcctgaaatcctccctgctcacaaaacagccagctacttggttttctaaaagacgtaattttgcaggcagacttcrtagagccattctgtgcagaasaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataaacacccagcagtcctttagcacgggcrtcaaggtggcccagytggaaaatttcagtgacatgccatcagatttgttccatgtagaaggacgacactatcagttagatgcttattttgttggcaaatttctatggcacttctgcttggcyayttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgasagygtaccmaggtcaccctgcccttcaatcctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaagagccacattcktgctggctttccarttcattctcctctcttcgagtccacctcttaaaacttcttagtgmtcttgcaagaaactcatgtcttttgtcagggagaatggcatggcctttgtatgacacttccttctagccagactcggatttgggggcatcatatttgggatggctgcaccgyaaacaggaaaggccacaggacagytcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttctgcaaatctggcacctggagatggcattttgaatcggacracctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagarctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcctagtggtgtattcacagagtcartggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcaratattttataacggagttgttaacattatttcctttagatggctcyttcatcttttctgcattatgaactgatgccccaaaaggtggtatgaatgaaagtcatstgatggtgattaaagtgctctttaaattttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcakagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattakacttgagccacacaaatcaatgggaaaagaaacagytgaatccagsataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcrctcacggtccacaccccgcccagagtcgtatcacttgactgcatttgaccattcagttttcagaccaactccawtgttactagatatcctgacactgaagaagctaaaaccaaacarcaatgacaacaacaaacccaagtctgccttatggcasattcttcacrtcgtaacaccttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttrattatggcttgcaaagcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcraaatgacgccatctcatcactccttytcttaaaatttttttttgtctttctycttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggycccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgctttctggtgstggcctgtttgaaagtaaaaacctgsttggygtgtaggttccgtatctccctggagaagcaccagcaattctctttcttttactgttatagaatagcctgaggtcccctcgtcccatccagctaccaccacgrccaccactgcagccrggggctggccttctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttstgttttgtttttgtgctttgtggctgtccgtgggccaagttgtctcacgcgattagcatgccagcatattttctgttaaagaaagaaagaaaaaagaaaaatgactattgtttcatttcaccttaagatgttttgttattacttacttacagtgagttattttagtcctcaatggtctgctcccctgcaattagcaagtacttagtgattgattagcgggtatctctatgtttgagaatgggagctgtgcagaagctcttatctgcgcatcccatctcatggacaccatgmtttccagcccgttccagcaagcacatgagaaagtccactctggcaagamggaraaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccayagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctktgcactggggcttgcctttccttgttgatmtttggaaccctgcaacttccatcatagggaacggctcctgggctagcctgctggatgatgagagacacgtagtcactcccagaaccggcatccagcagttasttagttagacatgtaagtgaggccatcccagactatccagccccagctgtgccaattcagaggagaagaaactgcacatttcactcacagcactgcaaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaycacacctggctaatttttcatattttaagtagagacggggtttcactatgttggccaggctggtcttgaactcctgaccttgtgatctgccctcctcagcctcccaaagtgctgggattacaggtgtgagccactgtgcctggcyttttttttttttttttttttttttttgagacagaatctcactctgttgcccagtctagagtgcagtggcgtgattttggctcactgcaacctccctccccggttcaagcgattctcctgccccatccttcagagtagctgggattacaggtgcccacaaccacacctggctaatctttgtattttcagtcgagatgggtttgaccatgttggccaggctggtctcgaactcctgacctcaggtgatccacccacctcagccccccaaagtgctgggattacaggtgtgagctaccatgcttggctattacatctgatttctaatatgactacagtcttgccagttcaccccttctccccattttactgatgaaaaagctgaggccaagaagtgtcaatctgctgttgtccatacagctcataaattgatagagctgcagttcacacccaggagtgtttgatttcaaggtcatgcagattgcctgcaccagtgccactgctccttccataagttgactatatccattctggtaggatgcaccatcttttttccttttaaacagagatggggtcttgctatgttgaccaggctagtctggaactcctggccttaagcaatcctcccattacaggcatgaaccactgtgcctggccatggatgcaccatcttaaaatcttaggctgatcagagaggtgactttatgggtctgactctagttatgcttcaagcatttggtggaagtgaaagtaaagccacgagaaagaagatattggcgtatcatcagccaaggtgctgtgcaaaatgtcaaagagaaccaagagaggacatgctggcctcctgcttcctggccgtgtctagggcctctatgctgacttcctcctctgtggatcctgcagggttcacatctgcaggctgacaasatgaggcctsggggarctttstaagggtagctgaggattctcccaaatcaagatttccaagtcatatagaccaaggcttcatacattcattcatttaacaaacataccaagtgctacatcctggaaattcaaggtttaaagtaaacccctccacagcctctgctataaaggaatttacatcttgggtctgtaggagtcctcacaaagcacaacgtcctactccactttatcagaagttatctasgttacttgaagatgaactgaggccccgtaacagtagcgattgccccctcatgcccatttctccctgaacccactcagtcagacactgtcagtccccatgggccattttctcttgccagacacatcaatcttatttccttggctatttctgtgataaattcttgacaggtgagcaagtgcatggcataattcctattattcctattttagcttattctatggccaaccctatttctccccatttgtcatatgtgcacatctgtatatgtatatgtcatgcacatctgtatatgtatgtcgtgcacgtgtatatgtatatatgtcgtgcacatctgtatatgtatacgtgtcatgtgcacatctatatgtgtatatgtacatgtatgcatgcacaaatatgtgtgccatacatgtaaaacacaggcattatagatgtataacacatatatgtggcacatgtgcatatgcacatatatgtattgcatatatatgtgtatattcacatatatgtatacagatgatccctaactcatgatggtttgacttaygatttttgaactttacgatgatgtaaaagtgatattcagtagaaactgtgcttagagtacccatatgactattstttcttcctttcagtatagcattcaataaattacatgagacattcaaccctctaataaatcaggctaagtgttaaatggttgtgttaaatgcctttgtccaactctaggtaaacttaagttttctgaacacattaaaggtaggctgggctatgctatgatgttcaatacattaggtgtattaaatgcatttttgacttatattttcaacttactatgggtttagacggtaaccccatwgtaagttgaggagcctctgtgtacatatatgtgtgtatttgtagtatatgatttatgtaataatgatcctactctatctgctacttttttttttttttttgagatggagtctcgctctgtcacccaggctggagtgcagcggcacgatctttgctcactgccacagccacctccggggttcaagagattctcctgcctcagcctcctgaatagctggaattacaggcacccgccaccatgcctggctaatttttgtgtttttagtagagatagggttttgccatgttggccaggctggtctcgaactcctgccctaaagtgatccaactgcctcagcctcccagagtgctgggattacaggcatgagccatcgcacccggtgtcatctgctacttctaatttcagatgctatttactgagcatactctgtgccagttgatgggttaggcaaatcactttatgctcataggatgaaagtgagttttagagagaaagtaacctctccacagtctcatagctggtagacagcagagtcaggatgtgaagccagctccatctgccttgaagcccatgggccttccactacacactacttttatgtgtggcctatagactagaagcatatatacattacattcatacaatgggtgaattatctgcaagggaagaccagttgatttcctatttaagaatgagctctggctcttctcctgataccgaaatgtccagtataaaccttacaaatcatttttgtacatgccatttatccagcaatattggcttcagccttgcctacatttctcaataggccctctctcctgttctgactgtaagttggtctgcaccttctcatggactcaacatcccgagttcttcgcgctcatctgatgctacagaatccacccaaacaggaagagtaggccagtttctctgcagtcgttttcttccaagtccctctctctccctaagtttctttcaactccaaaggtggccagtttccactttcacacctgattaagggagaccttgctgcaacttatcaataggaaacaagaaattgaagcattccccagcaatgactgaaggctgtggcttgtggttttgctttttaaaatggggttatgagtggttttgttttgaactccagtgaaggaggcctgatgacgttcatcaaggtcaacactaggccagaaaracttggcttgcaatatcactgcccattctgttcaccagcaggcaccatttttagaagcttatgtaaaaaaaaaaaaaaaaaaaaaaaaaaaatctaaaatagcaataccctgtctattaactctttgtgtctttcaatatatccaagctagtttagctgaggtcactttagaatactaagtaatatcacaaattattattcatataatcactgaacaaacagctctgagttgtatctatagatgttatgttattgcctttcaaggattcatggtatttggcttcatgccccccctttttttcccttcccccctcaaagtcatcttatttctcaaagttttccattattttaatggctacctcatatatcacataggtgatgggccattatttggaaacccattcccctactgtgggacatttaggttatttctagtttctgttagaactaatggttcaattagcatctttatgcatacagctttttccttctatyaattgatctcctcagcatacctttgtagagcgtagaactggagttccttgatccaacagctcctactggcctttgccacagagagccacaatgctatctggaagggttacacaggcagaaccagcatattactgtttgtttacaaccttatcaacacagggtgttcccactgataaca

SEQ ID NO: 13287 - DNA, 20320 bp, Homo sapiens
agctcatgcaatccacctgccttggcctcccaaagtgctaggattacagttgagccactgcacctggcctccaagctcttttagtctatatggaaaagtccctccacttagccatttgtttggcatttaaaaaataaaactatcactaggaatctaaaaaaagaacaagtacaaaagtgctgaagcaattaactttctgagaacagattctctagaaaagtcgcctcgaggtggtttggttggcacaaggctctcaggtatacatccctttccttgattcatccctgtctggggaatgctgcccaaagacctgccttgtagtcccgggccatccccacctctgtgttctcctccggcccccatctcaaaggatggggttgaagtagaagccccagtagatagatagtttgtagtttasttgggtgaaaaaaataaaacaacactccctagatatatgatgcattggctgacattttccccacttgtttggtgatgagaatcctctgggtcacctattaaggttccttcagattccctcctatcagattccttcacttgaggccaggagttcaagaccagcctggacaacatagagagacctcatctctacaaaaattaaaaaaataacagggcataatggtgcatacctgtggtcccagctactagggaggctgaggtaggaggactgcttgagccaaggggtttaaggctgcagtaaggtatgattgcatcactgcactctagtctgggtaacagactgacacgctgtctctctttaaaaaaaatcagatttctaggccccrtctaaagaatcagaatttacaaatgggtaacctgaaaatctgtacttcttcaactttcaagccaagtgactcttatcatcagacaagtgtggcaaagataacattactgaatatttattatttcagatacctgggcatctactcaacagggctttttttcgtctttttttttttcccccttcagggaaggataaagagacaatgccatcttagtgatgattatcaacacaggcttgggagcaggaaacctgggtttgatttgccaggtattggctgtgtgatcttggacaagttatttaacctctcagtgcctcagtttctttatccataaagtggggatgatattgcatctccttcactgaggatcaaatgaaataatgcatacagaactgttagtccagtgcctgctaaataaaagccattgtcaataaatagatgctattgttatttccccatagaagaaccctagagtatccccatcatataaatatgggtgaatagttgtggaaaaggaagactggctatgggtggttccaggagtccacacagatatataagcacagccagaaggcccagtgatcacttctctgactagacccagcagacacaactgtggctggctacattagacaaatggaagaacactttaatcagtctggttcaaggtgggcaggcaggaatcaaggcagacatgacttggatggacagctggagctatcctgggatgtcaccatgggttagaagtaggaagattcccagttagaaggacaagcacctccactagcctgattgaatttgatactgcctcagagatagttctccaaacctggagtcaaccaggtctgcatgtgagtcttggtgcttccatttccctggagtttaaccttgtggaaattgcttaagcccagtgaaccttcattttctcatccataaaatggtgacattaatagtaccttccttaaaggtgttaagatgtaaaaagaaaatgaatgtaatgcaaataaaagttggttattattattattatctatctttaacaagggataaattgtaagattgtattgtccccttggagacaacagacttcttttttatttttattttttgagacagagtctcattgcccaggctggagtgcagtggtgtgatcaaggttcatcgccacctcaacctcccaagctcaagcaatcctcccacctcagcctcctgagtagttgggaccacaggtgtgtgccaccacttctggctaatttttaaaaaatatattatagagacgaggtctcactatgttgcccaaactggtctgatactcctgggctcaagccatcctcctgcctcggcctcccaaaatgttgggattacaggtgtgagccactgcatctggcactcttccttttctttagtccctgccacattccccaccatcactgtctccagagtaaacaaagaacgcccatgtagattacccacatactgttcctcccattcactctgcacacacacctgcctccagggatccctgctccctcttcccacagatattcatacatttagtcctctagcagccttctcaaaggagactgtcccctctgcaggacgtggctgcctccaaaccctcctcagaggctcagcaaaccagagaaaagaagcaccttctgcaggagggtgggcaagatagattgargatggggatggatggtgatcgggaaaagggaggagctgaggattcagaataagaaaggagagggtggaaatgtgtcatgaagttcctcaaaatctgtgaatcctgaatctcatcatttttagtgaatgaactcagatgattcacttcccttcattagcctctattttcctctctgtgtaatggaaggggaagtgcttgctttgaagacagagatgcatatagaatccagcacatagaatccagcttgggagagccatgagcatgtggaattagacatcatatgggttatgaatattatgttagttttcttctgaataggattttttcagtatttcagcttctggctgaacatatatccctaaatattattgattttttggcagtcttcagcaagcccaccatttgctggttagtcatcccagtcctttgttcctgggcatgcccctttgcttctagttaagcatctattgccacccaacatggtaaccagaactctgagcagaagttttaggaccagggcctaactttggttcctggtgaggggctcagaatccagaaggtctggtaagccatgaccaacactactttttttttttttttaatggagtctcgctttgtcacccaggctggagtgcagtggcccgatctcggctcactgcaccctctgcctcccgggttcaagcgagtcttctgcctcagcctcctgaggagctgggattacaggcgtgtgacaccacactggctaatgtttgtatttttagtagagacggggtttcaccatgttggccaggccagtctcgaactcctgacctcaagtgatccagccgcctcagcatcccaaagtgctgggattacaggcgtgagccaccacacctggcaaactactttaaagcagtaagttcctgacttaggtaataastgggtttgggtcagggagggacaaagaaaaatttggccaagactcatgacatacatgcagaagtctgagctgagtggcctgggtaggcctaggaagcaggccagagctggtaaggcasaaaaagagtgaggaaggttaggggggtcatagcctgatgctggagggaccagctttagttcccctttcatggtgctactgacgacagtgtaacctcagggttcagcccctgggctctttgctttccatgagtaaggaagcaagaatgctgcctccctccaccccttccacagcctgctgggggcctgcagctccagcaatccccctatcatgttacatgcccagaagcggctttcagtgcctgccgttgccagctggcttcacccttcacactagacactcaggaagaaggggtccttagactcaaggaagctatgtgaccagcattccgtacctccttcccagaactgttgaagagtccgtctgccccatgtgtaggagggaaagaggcgcttcaggccacacagggacacagacaagagggagagggagtaagcataggcaatgtgggagtgaacagcacatgcagctgtgggtccagctgcctgattgctgggaactgctggccaaggatacagcatccccattggcctggaatcctggaatggactccagcctgacttggtcttctgagtcaatccagccacagtcaaaaaggggaggcaggcactcgatgtaggaattacagtttacacagttcctcttcctatctctagcatccagaactgcgcccagcacacagtaggtccatgataaatatggaatgaatgaatacttttacatgcaagcatgatctcagccaatctgcagagtgaggcacaggctggacaggtggatcacctgaggtcaggggttcaagaccagcctggacaacatggtgaaaccccatctctactaaaaatataaaattagaccggcatggtggcagacacctgtaatcccagctacttgggaggctgaggcaggagaattgcttgaacccagaaggtggagggtgcagagagccaagattgtaccattgcactccagcctgggtgacaagagcgagactccacgtcaaaaaaaaaaaaaaaaaaaaaagagttaagcaacttgcctaagatcattcaactttgatgtagcagactgaaggctaggcactgtggtctttctatagtgccatgctgagcattcttcatatacaacacagaattgcatcctatgactccatgggaacttccttttgggtcagaaaatagtccttaggggctgagtttcctggacttagtctcagggccaggtttggataccctgcccctccctgcgcatctggcatctgccttcccttttatgagaatctcctggaaagggcttctccagcagtctgtgttgccacatctgactcaggagctctgtacccttgagacacagaggcaggggttggtggcttcaccctaggagtcaggaaaagaatgaaatcatacacattcagttccttattctcttaccctcaacagaaatttcagacagcctagaccacagagacagttcttggaattcaggcaaacaactaatttgtattacagcgggtgcaacttaagagctcagagtccatagtccgagcagtctttctggaaggaggtctccaaagtcaggaggagggctcccctgagctggatcatcttagctcactggcccctcccttcacagcgttctgtcttttatggagacagtgaggtatagcgcataggaacaaggatcagaagacgctgggttttagtgctggctttgctgctcatcaactgtgtatcttctctccacttcattttccatatctgcaaaatgggaacaacaataccagtctatatcataaggcagttatgagtttaaagagaaatggtttacattaatgtgccttgaagcacaagacagaaatacaatataaaaaatatggctggggccgggcacggtggctcacgcctgtaatcccagcactttgggaggccgaggtgggcggatcacaaggtcaggagatcgagaccatcctggctaacacggtgaaaccccatctctactaaaaatacaaaaaattagccgggtgtggtggcaggcgcctgtagtcccagctagtcggtaggctgaggcaggagaatggcgtgaacccgggaggcggagcttgcagtgagccgagattgtgccactgcactccagcctgggtgacagaccgagactccgtctcaaaaaaaaaaaaaaaaaatatggctgggcgtggtggctcatgcctgtaatcccagcactttggaaggatgaggtgggaggaccccttgaacccagaagcccagcaaaaccttgtctttaaaaaaaaaaaagaactgtgcacaaagatttcagagagtgctaaagattagcgcatggataaggaagttctgtgaagagttgaagtgctaggtgaagaggtggcacgggggaggagggggcggaaggggagaaagggtgtcacgcttcataacggtctccaaacctctttgtccaggaggaaatgaagtcatctgctctcagcaatcagcatgacagcctccagccaagtaatctggagtcatgaragctgctaggggagcaacatgaatcatgacggyccctgggaatttcctgataaytaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatckctgactcagtctgtcccctggaaggctggcagctcagcaagcacagaagtctctccagaagacagtgggtcacctgcctcccaaaagctgaaaggctaacttgtactttccccagcaggcagctggcaycctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccmgtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcartaggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccakagaggagagagacagctggggagcctggtcaccgcgggcatctcccctgcgctgcagtcgcccgcctggcckgccttcccrttcctccgcctcttgccctgacttctccttcctttgcagagccgcygtctagmgccccgacctcgccaccatgagagccctgctggcgcgcctgcttctctgcgtcctggtcktgagcgactccaaagtgagtgcgctcttgctttgactgatgmtgcccaaggacctctgatcagcaccaggggagaggaggggctgctcagggagctggggtcctccggattccatcyacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttycagggcagcaatgaacttcatcaagttccatgtgagtatccacccctacaacagttggctgcacagacaarttgggaagrcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcaygaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagkktgagtggatcatttgaggtcaggagttcaagaccagcctggacaacatggtgtaaccctgcctctactaaaaatgcaaaaatcagcctggcatggtrgtggatgcctgtagtcccagctacttgggaggctgaggcaggagaattgcttgaacctgggaggcagagatctcagtgagctgagatcacaccactgcactccaactggrcgacagagcaagactccatctcaaaaaaaaaaaawaaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctgggraaacataattactgcaggtgargtgggggcaacaaggaccaaaagccctccctacagcttcccagaaaccttgttaccatccccttctcccagagggctggccatagcacaagagaagtgcrgcctctggttgagtcttccctgaggggaggaggcagggaaggccctctggrttggaatgacatcccctatctttctgtgttgccaggaacccagacaaccggaggcgaccctggtgctatgtgcaggtgggcctaaagcygcttgtccaagagtgcatggtgcatgactgcgcagatggtgagcatcactgacctgctgatgacagtgggrtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatsagcccttgctgggtgatcagcgccacacactgcttcatgtacggccctgggtttctcctcttcgactcttctgccccaccccaagcacatccctttctccttcccagcaaagtgttcygcctcatttctccctcatctgcccctgtccatgcagcccatggccttggggacaagtcgtgctttgaggcctctagggagggaaggaagaagtggcagatttcatgggactaagctgtttgatgggtatcttctyccacagtgattacccamagaaggaggactacatcgtctacctgggtcgctcaaggcttaactccaacacgcaaggggagatgaagtttgaggtggaaaacctcatcctacacaaggactacagcgctgacacgcttgctcaccacaaygacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagcctygggatggattccagcctaactacctcagctgggagtttttgcagaaacracctgtacagctgtatgcagtggctctggmcatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccrttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagygtgatcaagggaagactgcagagttagaggtgggagcactgargcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctrtgtgctgctgacccacagtggaaaacagattcctgccaggtgagtgttccaagcatctctctccacctcttccatatctccccagagctcctgggcttgtyccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtsaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgscacccaccagggygaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtktgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtggactgcaccctagagtttcttatgggactgcatctctggacttaatggagctttgggaggtagaggttaggagagctgtagggcagggccaccacagcacttaatgtatacaaagtttccccaaaccacaatcccatggctgtgtaagtagtgtacaggcttagtgtcagctcccaattgcctccttaacctgatgcctttgtgcagtgcacatcttgtacagctgtacatggtggtcttctttagggttaactccacaacagtctcttcactctgcccccaacaatccttgagctgacctcaaccaagaagaacacctgtggccaggtgtagtggctcatgcctgtaatcctaacattttgagaggctgaggtgggagaatcgcttgagcccaggagtttgagaccagcctgggaaacttagtgagaccctgtctctgcaaaaaataaaaaaattagycaggtgtggtagcacatgtctgtagtcctagctacttgggaggctgaggcaggaggatcmtaagccaaggagttcaagtttacagtcagctgattgtgccactgcactccagcctaggtgacagagcaagaccctgtctcaaaaaaaaaaaaaraagaagaaraagaagaagaagacctgtaagtgaaaattgctggccaggctcagtggctcacgcctgtaatccagcactttgggaagccgaggtgtgtggatcacctgaggtcaggagtttgagaccagcctgaccaacatagtgaaaccccatctctactaaaaatacaaaaaaattagccgggtgtgggggtgggtgcctgtaatcccagctactcgggaggctgaggcaggagaatcatttgaacccgggaggcagaggttgcagtgagccgagatcgcaccactgcactccagcctgggcgacagagggaagacttcgcctcaaataaataaaaaaawaaakaaakaaagaaaattgcttatccagaatgccagcttgactctgtggcattcaggaaacaaaaamcataatttcccatcatctgtgtgtgggactgatgctggaattttctcagtgtgttaacagagcttgtgaccagccattgctatgcctatgattagggggcccagaatctcaaagctggatgatgtcctaatgggggtgactatatattttgaacaaaacatcaagttctgaaaagctggggtgtagaaggcaggttgggagataattgggtatcaaaaattagaattgccaagctgtgttaatgggttggggcagtgtttcttaatcgagtcatctgaggaccttttaaaatatgcacacctacactccacctgtagagattgtgattcaggtcagggctggctccaggtctygtggttttagaaaagctccctcrgtgttactaacatgcaccactgattgacagcctttggggacaattggtcagaatatatgaagtgcccagaaaaattcaagatatggtcagcatgagttctctgcatgaacagccagttttctgagtggggtttggtggcacaaggtctcctggatttcctggttaaaggctttctggaccgtgcttccctagagggcaagaactccaagtatttggctttttcttttttttgaggcagggtctcactctgtcacccaggctggagtgcagtggcrcaatcttagctcactgcagcttctgcctcccaggttcaagcgattctcctgcctcagcctcccaagtagctgggattacaagcatgcactaccactacccggctcatttttgtgtttttggtagagatggggtttcaccctgttggccaggctggtctcgaactcccgacctcaggtgatctgcctcccttggtctcccaaagtactgggattagtattcggcttttgatccccatcatctagtgtgctgttttacacaggttgatgcagtggtttagagcatggattttcgagtccggtggcctgaactagaatctaacaccagctgtgtgacttgagaaaggttattagcctctctgcacctcagtttcctcatctgtacaaaagagatgatacaatctacctccctgggttgttataaggattcatgaaggccagacacagtggctcagcctgtaatcccagtgcttcgggaggccaaggtgggcggatcacctgaggccaggaattcgagaccagcctgaccaacaaggtgaaaccctgtctccactaaaaaaaaaaaaatacaaaaattagccaggcgtggtggcatatgcctgtaatcccagctactcgggagtctgaggcacgagaattgcttgaaactgggaggtggaatttgcagtgagccgagatcacaccactgcactctatcctgggcaacagagagcaagacttcgtctcaacaacaacaacaacaacagaaaggattcatgagttcataagtcctttagcataatactggcacctaataaaagcataaaaacggtggttattattacaaagctaagtaaattattgtagcatcagatcagatgggaaccctytgccctctcccacctcagaactgcactattttgcgggagtggaaacctgctaggaagctgcccaagccgagtggctgttcagtttctgccttcccctcaggggccaagaaagatcttgttcaaacttgagcagctccagcatcagggctcagagacactgaaaacaggaagtatgagccctactggcagggttaagccaggaggctgttaacaattttcaggccatttcccagccaacaccctgacccccagccagctgctgtctctttgcctaatattagatctcaccccaggctagcaggcatcagccgcttctccagcaaccagtttcacagttccagattctcactccagagactgcctcctattagtgcctccaygatcaagcactgtgctttttctgtttttgcttttgttttttttkttttttttttttttgagatggagtatcgctctgtcgcccaggctggagtgcagtggtgtgatctcggctcactgcaacctccgcctcccaggttcaagcgattctcctgcctcagcctcccgagtagctgggattacaggcgcccaccaccacgcccggctactttttgtattgtttttagtagagatggggtttcaccatgttggccaggatggtcttgatttcctgacttcgtgatccgcctgcctcggcctcccagaatgttgggattacaggcgtgagccaccgtgcccggcctttttttttttgtttgagatggagtcttgctctgtcccccagtttggagtgtagtggctcaatctcagctcactgtgcaacctttgcctcccgggttcaagcagttctcctgcctcagcctcccgagtagctgagattacaggcgcccgccactacgcctggctaattttttgtactttcaatagagatggggtttcaccatgttggccgggttggtctcaaactcctaacctcaagtgatcaacccgcctcagcctcccaaagtgctgggattacaagcatgagccaccatgccagaccaacactgtgctaaattattcatgtgttgtctgagttaatcctcccaagaatcctatgaggaaggtagtatcactagccccatttaacagtagagaaaatggaggcacagacagattgagtgacttgcacgaggcaatgcagctccaaatgcaaagagtcagggttcgaacccaggcagccatctccagagtcctcatgcgcggtactaggatttatcacctctcaggagagtccaactagggcaaaaggagagcagcccccctttcaagctttctactttatggttgctgggtttctaggcaacagctatcagaattttttttttttttttgagacggagtctcactctgttgccaggctggagtgcagtggcgtaatcctggctcactgcaacctccgcctcccgggttcaagtgatcctcctgcctcagcctcctgagtagctgagattacaggcacatgccaccacgcccggctaatttttgtatttttagtagagacggggtttcaccatgttggccaggatggtctcggtctcttgaccttgtgatccacccgctttgggctcccaaagtgctgggattacagttgtaagccacccgcccagcccagaatttttttttttttttccatacacagtcttgctctgtcgcccaggttggagtgcagtggcccatctcggctcactgcaacctctgcttcccaggttcaagctattatcctgcctcagcctcctgagtagctgggattacaggcgtgcaccaccacacccggctaatttttgtatttttagtagagacgggggtttcaccatgttggccaggctggtctcaaactcctgacctcgtggttcacccacctcggcctcccaaagtgctgggattacaggcgtgagccactgcgcccagcctcatctatcagaattttaatcctctcctagataacaattctttcctcctagaagattcccaggccagatgaggagaccacactcagccattggtttcaaagtaaaacttcactgttctcacagtaacctcagcctttctgctgcaatctggtttcattgaagtggtttccgttttcaccagaacccctctttctgaagtattctcagcccattatattaacagcactcagcctgctttccacgtatgccctatctttcccaagctgaccacagcagcacccctgcctatacccctccatactcactcccattgggtccaccttccttccaagaaggaaacatttaagccctccctttgaattagatgaagtaagaggagttgctgaggtgttttttraaaatcaattctgggctaggtgcaatggctcacacctgtaatcctaatactgtgggaggcctagacgggaggattgcttgagcccaggagctcgaggctgcagtgagctatgattgcactactgcactccagcctgggtgacagagcaagaccctgtctctaaagaaaaaaaatcagttttattgagatataattcatatatcatacaacttacccatttattctttctcttttctagagacagggtcttgctctgtcacccaggctgatctcaaactcctaggccagagtgatcctcccacctcagcctcctgagtggctggaattacaggctcataccaccacgtctggcaccatttgaagtgtacaatgcaatggtttttagtagattcacagaattgtgagacatcacaatcaattttagaacacttcatcacctcacaaagaaatcctgtacccactcacaatcactccktttttctccccaaccccctcagccctaggcaatcactaatttactactttctgtcctctctgtgggtttgccaattctgggcatttcatatcaatagaatcctataatatgtggttctttgtgactggcctctttcactcttaacatgatgttttcaagttttatccatggcatagcatgtgtcagtgaggttgctgagttttaataacaaattgagggaaaagatggtctaggcgaggtgcagtggctcacatctgtaaattccagcactttgggataccaaagtgggaggatcccttgagttcaggagttccagaacagcctgggcaacataaagaggccccatctcaaaaaaaaaaaaaaaaaaaaaaaggatgttctaggtctctttttgaggtttcagtcacattgagattcattcaacaatctttgtcatttctttctttctttctttttttttttgagatggaatctcgctctgtcgcccaggctggagtgcagtggcgcaatctcggcttactgcaatctctgcctcccaggttcaagcaattctctgcctcagcctcccgagtagctgggattacaggtgcctg

SEQ ID NO: 13288 - DNA, 76559 bp, Homo sapiens
  misc_feature (1)...(76559): n = A,T,C or G, or insertion/deletion polymorphism (see Tables 1-2)
agtgggtgctgctgcatgcaacagtggactcagcttatagggatctgtttgctcacatgccaaggaatatggtgatggcaggtactgactggcttagatactcagctcccctctgtgtttttgcttggccatgcttttgtcctcattgttgtacctcacagtgagaagatggctggccaagctcaaaacatcacctccatgtttaaggtagcaagaatggggaaagatacaactattcccttaaatcaccaacacaaaacctttccagaaacccccagactttcatgagatgtctggaagttagawcaggactataccaaatggccacctttggctgcaagagagactgagaaagtaataatcttacttctatagtgatgggggccagggagaaggaggttggaartaagggttgaagaaatgaacctatcatttctgccacaaaagctagcaggtgacagttggtgaggacctgagataggccaayggtaatcgagaaagggcaaatattgttgccatggactaaaatggaaaactcagaaatactgagtattgaatctagttatgctagatgaagacttaggtattgtctcggggagatgttcagcagggagctggatgttagttctaaacttaagtgaaggctcaggcctggggatatatttgagagtcattagaatataggtgggaagctgggccatcagaggagtcaagacactccaggacagcatgacatgagaagagcagtaggccatggtcatgccatacatttagacatcggaagcagagcatgagaaattcacaggagatactacaacaaaatggctggaaaagtcaagggaktagagaatttctagaaatgagtggtcagtaggatcagaaacwaaaaggcccagtaagataaaaacaaaaactacctatagggtttggtaatatgattttgctgttgktctttccctgagcagttcagtgatggggttgggaagattatttttgcagtggaaagaaggaggcaggaagtataaattcctttccagtagagtttttgaaagtaagagaaataaaactaaggcaacaaataagtagggaaatttgttttttatttttatgggtaagactgggcagaggggatttagaggcagaggggaagaggccaacagggagggaagggttgaagttacaggagactgtatcactataagggtgaaaggcttaatcatgattggcttccaccaatcttagggcatctgccagggctgaggaagcaacccatcattcccgggcttattgcaccctttacctgaacaatatggggtttctaaaaccaaaaaaaaaaaaaaaaaaaaaaaaagaggggatggctgttgggaraggttccaatagtgtctgccacaccaaccctctctctacttaaaaatgtcacagcagaattgcatctgcagtgattcatatcaaaagcttgaacagtcttttcayattgcacattttaatttaaatactttctcacttcatggttctccttaggcctaacctactttcaattaagcctgagtctgtgaagacatactaacttgttcgagtctattttctctacatgctagcacacacaccctggaatttaatggatagtaaaattatgcaaagaatcactgtgtgcaacaagaactgggacatttcctgccaagcccacctccaatacaaacatgtacacacacccatcggtgctatacatagaacttgctcttaaataccaacatccatttgccacactgtggagcaaatatgcttccattctcatgattaaaataacaggaagtatcatcattcttgaagtmttggtatttataacaacaatataaccacaaaaaatatgtaactgtggagactcttgataaggtctattggcaaggcatctggtagcatccttggcttgatgaaaagccctgtatctaaataatcttacttttcaagcaatgctgtgatgtaccctgaggatccaatccaagaagggtaaaaactgctacagacgtcctctataaccyccagcctgaaaggggcctytgcctcttcagccagtctggcaggtcatggaaattctactcttgcaaagagagctgtggatacaagcaaagtatttcttcagtatttactttgactggtgaaagagccacggcagatttttttctttttccccaagacacaaaatgacattttaaagaagaaaccactcttggtgccatagcgtcttttaaaaataatatcagaataaaagctcaaaggcatgttctcttaagcacagctgtccaaagcctcctatttcagggagaattcagccactttatgcagacaggaaaacaaaactgttcgttttagcatcttctctattgkaactatttttttgtactcagattgcatcagattcaaaactagtgacatcctcttatgctctgtttccccaaccagatcatgagctctttaaggtyaggggccacattttgtactcctttatttcttgcagagttgtgtttgtcatggtgtactttcaggaaattgttgttgaatggatgaatgaatgaaagaatgacaaaaatgggagagcagtggtaggtgagttgctaggcagcctggtaaagaggattacaagagtcaggtcagattagcaggaaaggtggtgtaggggaaagaatgttgcattctgagccagcagacatgggtcctagtcccaggctggcttgcttgtcttcactcattcaacaaacatttcttacacttcaagtgagccaggcaggcattgcggcagacactgaagaaggcaaaatccctgccctccaggtgtggtggtggtggtggtggtgrtggtggtaagggaagcatgtggagatcaggattatgggagagatgtgtgataggaggtatgatcacggcaagcacagggcacatggaagcaaggagaaagggcttctaaatcagactgtggattccaggaaagcttcstccayctgaaaggaaaagacagaggcacaaaatataacaaaacatttacttgagccaaagtgaggacagttgcccggaagacttagacccaagtaaccctggatatgagcttcatgccgcctttattacaagcaggttttttacaggcagaaaagggggacagggagtaggcygatatgaaattgtttgtaaggaattcacattggtttacagaaacaacattgctcactgattggctatgcactgttaagctataggctatgagtgatagtgtccagtgtgacattattaggttaatgtatagttacttgtggcaatagcaagcagtttcaaggatgaatacatagctcaaaaggrggcagtagtgttactggaaagagttcctgatccagaccctaagagagggctcctggatctggtgcaagaaagaatttggagtgagtctacaaagtaaagtgaaagtgactttattagatargtaaagaaacaaaagaataggcagagcagtggcgtcggctgcttgactgattatacttatggttatttattgattataagctaaatggggtggattattaatgagatttttgcaaaagatgtggggaattcttttctcttcccagattcctgaaggaggagggttttgattcaagccttaaagatgagaaggtgttggcttgaaattgaccaagaaattgaccttttactgtaggtaaaaggacttacctgtgaggatgttgtattggagaattaaagtctcagcttcaggtgagacttcagggtggctgtgacgggagataaagttagagacataaactagagctactttccaaagggccttgctgcaatataatttagtggttaggagtggaggtttagagatcagacagaattgggttcaaatctcagctttggtacttaccagccatgtgataataactgatttttttaaaatcccatctgagctttagtttccttaacacaacgactrcctgttatcagttgtctattgctgcataacaaattatcccaaaatgtaatagcttaaagcaacacacagcttcttcagcttctgaagctgaagctgtaattmtcasttttggttggtctggaatcccaccaaaactataattataatctaaccaaaactataattctcagttttggtgggtctggaatctgcacctggcttagctgggtcctctgcttcagggtctcttgcaaggctgcaatcaaatgtcagccagygctgagataccatctcaagacccaactggggaaggatccgtttccaagctcactgacatggttgttggcagaattcagttccttgctgactgttggccagaggctgccctcctcagttccttgctatgtgggcctccccgacataacagcttgcttcatcaaaatcaatgagagggaaagtcaactaacaaggaagaagccacaatcttatttagccttcttctcatcactcttgccacactatgtttgttagaaatcacaaggccagtccacactcccagggcagagattatacaggggaatgaacaccaggaaatggggatcattggagaccatctcagtgtttgcttgccccaaagctcatagcttagtaccactaaataaatgttagttattattattatgctgaatcgagagataaagtaaaactacagagggccagtagttttatatcagggagtaacttcagatgatgttgggcaagtcaagtcatctgtctttgaactttcatttcatcctcagtaaaataaaaatacctgaccccagaaagaatgagaaaatatatgtgcaagcataaatatatttttggaacatcaaatatacaactctccactctgaggaagcaaactgctttgggccagttttccattttgtgtctgctctatgagtctcacagtctgatgtcttcacgttttttagcgtttggtccagtgggcccataggaataaacacctacaaagagcagtgtgtctctggagagtcctttaaggcatttccaaggatttgctttttggtttttttctttctttcgttctttttaaatatctttgcttttaaggacctcatggggggcctgggagagaaaacagactgtctgggaaattttaagctcttgataataaaaatggtaataaaatctcctccagctcctgaggcttcgcagaggggatgtttatggtggatggggttcccyttctcctgcgcagctggtttcgaggttgtgcggtttccagtcctgcrgagcagctcaggttaccgcctccgtggccgcgggggagggcatctccgacggccgcagcaatgggcaagagatcagggtcttcccatccccgcgactcgcccctttctgcctggtaaccaagcgggatgcctcatcctactccccaaacggagcggatcacacacagtagtrtttcatggtctttcctgctgcggttttcccggggraaggtacttccagagggtggccaagtcttccctagcggccggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaycccagggcagggagcaaagctcataccgcaacyccgccacccgcccgcgccctgccagcctgttggggccacagcgcgcaggccagcagccgcactcgccgctgcggrgttccctttgcgctgagctcatctcctgcaacgccgctgccccaraccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgchgttgctaatgttgcgggccgcggcgctgcacccagacgagctcttcccacacggggagtcgtggkgggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgyctccagaggggaggaaacagaccccackcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccrgtggggaaggagagagaggctttttgcctaagtcagttcccttccctccctgcgcgaaagggtagcgtccttgggcttgagcractgtcacctttttgtccctctcctctcccaggtgggcaccaacggcatcatctccactcaggacttccccagggaaacgcagtatgtggactatgatttcccyaccgacttcccggccatcgccccttttctggcggacatcgacacgagccacsgcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagaggtaagtgaccagggatatttgactgctgaggaaattgaaggatgrgcttaaattctggggcagcgacccagggactggctcggagttgtttctgagcctactcttgcgctgaacctgaccttggaggcagcagggctggagtggcttgggagtgaggaaagacgttgtctctaggcatcttctgaggccctrgcaggtggtcactcccttgaggaaaaaaatgcttagcggatatgagagcgggagtgcagatgtgggagcccctttgaacataaggcaatttactgtttggttgcttatttttagaaccatctctaagtatacaagtatttctaattatatgttcattgaaggggaaaaaatcagaaaatacagataattttaaaaaagaaaacaaccactcattttcccaccactgataaacatttttctgcgtacattttcagagttttttcttctgcatatctttattgctgtctattaacaatgatgagtttacactgcacatactgttttataacttgcttttttcacagaatagtgtattgtaaatatgtttcaatgtcaataaatgtatttctacatcatttataatgatgcatactactgtatcctgctattatcctgtataatagtgggtgtaccacagtatgctcaaccagtgttgggccattaaggctttttctggtttttcattattataaataatagcgtgaatcactttttaaaaagctaaatctttgcacatgttcttagttgacattccaggaagtgcaattggtaggtcagagaggatgcacttttgrtaaagttcttgataacttctgcctaattgccttccaggtaccagtttacaagtttcttagtttataggagtctgccgtcaatgtgctttacagtctctacctgcggaaagtaaaaaattccaggctcctggtctttagtcttgtcatcaacatttgaagtcctccaaatggatatgagtggggccagcgtgcttggtaaatggcaaactgcctcattcctgaagaaagtaagggcttccttctatggaattagacctgaatctaaaataccatactctaggggctgaaaccatatgattcatctcaattttaacttacggaaatgcytcttcactatagaaggatggtacatgccccctgtaagaggtgaggttgcttgcccatgtcactgatctctatcttgtaaggatgctgtgacttatatcttttgtatggggactctttattttttaatttttgagggtacatagtaggtgtatatatttatggggtacatgggatgttttggtacaggcatgcaatacgtaataaycacawcttggagaatggggtatccatccccccaagcatttatcctttgtattacacacaatctaattacactcttagttatttaaaaatgtacaattaagttattattgactataataacctgttatcacaggttatartcaccctgttgwgctatcaaatggtaggtcttattcattccttctatttttttttttttggtacccgttaactgtgtccaccttcccctgacccctactacccttcccagcctctggtaaccatcctgttactctctatgttgcataaggactctttaaatgcaaggtttttggaattaaaacttttgtctggtccttttctggggtgggggaggtttagggtagaagagatttgtaaattccatctctcttttacttttctaattaaaatccmcctgcagacattaccatttgctagttggcttcagaatgtttcattaagaaaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccttaaaaaatgatgagttcatgtcctttgtagggacatggatgaaattggaaaccatcattctcagtaaactatcgcaagaacaaaaaaccaaacacygcatattctcactcataggtgggaattgaacaatgagatcacatggacacaggaaggggaatatcacactctggggactgtggtggggttgggggaggggggaagggatagcattgggagatatacctaatgctagatgacacgttagtgggtgcagcgcaccagcatggcacatgtatacatatgtaactaacctgcacaatgtgcacatgtaccctaaaacttagagtataataaaaaawaaataaataaataaataaataaataaataaataaaaaagaaakggraaaaaaaaaaaaaaaaaagaaaggcaggattctgtttggataggggatgttctttcaattacccacattgaagtttcttccaatattttaaagagctctgggacttgagttcttgttttaatagttctttggagatagactttggcaaacagtaatctaatttgcttgaaggactgagttctacatggcgttcttaaaktttggcttactaactttatattgcaaagttactggaaactggaagattcaaagcaatggcatctttgccattaaaaacaattgcagttggtgccctttttctccatggatattcctgtcaggtgtgaccagatgttgcacctgatattgcaggaatgtcaaggtgtaattgtatctgaaaaaaaaatgtgaacaaatagtgtttgtcaattcagttaatctgagatttcttgaactctcataggtagttcacagagcaaaaaagttatggtgtagacctttgaaatacttattgatgggagacatagaggactaatgtttagctgtgctttttgtggggaaagaggagtgttttgtttttgtcattttagggatggggttagagacagctgagttatatagatctctgtaatgtggggaatrttttgtttatctggaatttaagtcaggttgaaagggctaaaaagaatggatattgagaatgaggtatcaagagagattgttctgagcaaaaacatgacccaggagaaggttgagagagcaacctattagcaaaggggccagagaaatggatgaaggagtcacaggcagtaacataagacagatgagtgcaaggttgcccgctatggttgaatatttgtcccctctgaaaatcatgttgaaacttaatcctcaatgwgacagtattgagaggtggggcctttgaaaggtgactgggtcatgagggctctgccctcakgaatggattaatttattcattcatggattactggattatcatggagtgggcctggttgctttataagaagaggaattgagacctgagctagcacattagcacactcagctttgtcgccatgtgataccgtaagtaccctggcactctgcagtcaccactagccagaaggccctcaccagatgtgacctctcaactttggacttctcagcctccataattgtaagaagtaaattccttttctttgtgaattacccaatttcaagtattttgttgtaaacaacagaagacaaattaagacactgcccaatggaggcctccatctgggtggagactgagacatgttgacttggttcaaaggttgatagtcattgatggaggtggttggatttcacagagaaaatgagaggtaaaagcaggactttattgtagctttttgacttctggagacaaggtttagaagaggggtggtctacagcccatccaagagagttcagactgagtctgagatatcactgtgaagatgaagagaatagagacatatatggaaattggttaatgctgaaccatatatggaaattagaaatgctgacgttttgctgaagagtatcaggaaggatatagtattagggatgtgatagcactcagcatttgtctttgaatttttggcaggatctgtaggatttagtgcagtaaaataaatgagggacagtcccscatgtgacagtgtcctacaggcagtgggagatgaagaactacactaaggaatggaggttagtgttcacagcaaacactggaggccagacccaatgatcctagagctctagaggacatgtggtcctgaggaagatgacaaagagaactttgtgacccctataagagtcaccctaattcttcatttccattttmattttcattttgataagcctctataggcaagccccttgaagaaaaggatgtcactattctgatttttgkccagatagctgcagttaattaaatgaattgaaaaaattagaaactcttagaggggtgtatgttgcatgcatcagcctggctctgatgagtgtcacttcaacattgattgggatgtcctgtacctgggagggagagtcaggctctggtttctgcagagggctctggcttttctctctttctgataacagggcctgcagccactcaccctgatcctctctgtgctgctcctctccctgtggaggcccctctctcctctctgggatcctgggggagctgggaaccagtgactcgtttgtcrggtttggcagcccatctgagggcttctctttggagacagagcctgtgcggctcttgcaaargcttgtatctaggaatgtgaggacctttcctgtttggaagccagtcaaggagttttttgrgagggggagcccttcaagacttcatgaagtgggctctttagcaattagatgtagaattttgtagaactgaccaagaactttacaagtgatcatttagtgtgtgggtggcttttaaacagccaaactcttttggcgtgtactttgggatcataaattctacttaaaaggaagttgtttccttcctctgatatttgcctattttggtggagacaargaaattaaatacttgccacccataatgagtgctcatctcaagaacagtatatagaagatgttgaataaattttaattgaaatgaatttgttggctggttgamtgaatgaatgaataaaataaagtgstaaatgcccagagttcacagcaaaaagtcagactctcctcttcwcagctctgtttactrctctcttccccccttccccatccccttcaattcttcacagtctctacaacctccttatcttatggaatttctctaaatttagaaccaggattctctcctatctcacatttattatggcagatcaatgccaggagctttgaaagcttagctttttgaaatggggttttttctccttcctctagtacttttctttccctagttgatttttctttattctgactaatgtataactctgaagttattgagtccacattagttgatgatgtcgactatcttatggatagacatgaggcagaacagcctttgtttatatttggcagtagttgtggcttcctagtattgagaagctctaaaaacatttcttgctttttgtttttggraaagtcaagctttgctgatgaacaatcaacaactggaacaataacaaataaactaggcacctgttactttgtgaattgaatgaatgaaaaaagcaaagcaagatgttgttttttctgggttagagaactaaaagaactgctgattgtattttattttctcttgaaaagtgtgttacatctatatttctttatcctattagcaaaacctcaaaaccttactttgaaattaaacattgaaaggaaaaattaacattagaaaagagctrgaacaactgtgggagtagacttagaacaaagggaagagcccattccttccttgctgtttccttcagtgaaatgtgatgttcttctctgtgcccgagtttgtctgtctagcagaatggaaaggtaatgatacttaccagtaaataatatttctaagagtcacattatttrtgaagtaagttgtgttttaaaaataccttcccagttccttactaaattgtaaaagtagtgtgatttagtgagagagagacagtttcagaagcctaaacataacagctttttgagaatcaagcactgttcacagatctttaggaggagcggtcgctgaatgaaggtaaaggcaaaaatctcatcttgttgaaaatatgagggtaaacagaatgttaaggagtgatcctataaggacctgggtgttgaattggcagctgattcaggctcctggtccctctctggtctgtgttggctcctgcagtgtttataacattcaccagctgcctctgtgacacctcccaacctccaccctgagatcctggacacacaccccggctcttggcctctaccaccttctccagtgactctcctaccatttcaaccatggctgtttcccagtcctacaccgtgagactctcctgggcaaagcctgtcttttgctccttcacatcctcagcatcaagcataacgtctggtgcttaagtagacacttggctgtttgaattagtgtatgaatgaataaatgaatggtgtttacaaacatataaacaactaaccaagcataatgaggtgaatgctcactagagatgcccataaaggtgttacagaggttcagagaacagaaattattctatrgggaatcacaaacacctctgagtggcagcatttgaaggttaggaggctttctaggcacagggaaccacgaacaaagtgtagaagcatccaaggacatggtacaaatggggactattaaatagtctgacaaagatgcagtggaactgagcctgggagggacgtatgcagccaggttacaactcaccttgaatgccatgttgaggaggggttagggtgtcctagggtgtgggctctagagctggctggcccaccaccacatacttgccacctgacctgaggaagacctgttagcccctgtgtctttttctcatctgtgaaatgaggataaccctgatgctcgtatgaaagggtagatggaagaggaaagagagtkatgctgtgagacagtwaggaggccttttgaccaactagtgcctaacacagtgcctgcccatagtggtcatttaatraatggatgaatgaatgaatgaatgaatgatgcaaatgagagatgctgagtgcctagggttataaactagggcagtgactgcaggatggacaagttaattttgctgattgctcttagctctgaaagagtttacatgagagaagtttgaaaccttacaaagtatatattttttaacctatgttttaccaatgcgtatttcaactattaatctaaattgacaaatggtatttgcaataataaataatattgcttatgaaattatattgttaacttgaagaggaaattttaaagaaggttatgtttaaaaacaatttggaggaatcctgaaaaagggkamrttctttgcacgttatgatgctttgcttgcattctgtttctttyttcttttatttgttttttacaggatgtttctctctctctctctctytttttytttttttttcctcacagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcagtaagtaacattgagctgaagccctttcctatttgaatataaggacttttaggaagtacctgaacacaagtgaccataagaccattacataatatattggtggcttctaagtaaggcatcaagtcaaaaccaaggaactagattcaaccctggaaggatcaagttcaccaaaacataaaaggtcctttatttttcctgctctattgggtatagatactggaaacagaacagtatgtgtgtgtatttgtagagccactgaggcttgctatgaaaaacattgctcttggaaccacataaaaatatccagtcataaactgcccagtttgaggttttccagattaatcatttcacaggaggaaacattgtgatttagtcttttggacagatactgttaaacattaaattgagcaatgtaatttgcaggaaaaataactaagatttataggtttccagaagtctgaggatgtctctctggcttcattacctaaaatgaattgaacccattccttagactcatcagtgtctgcccataatgggcatttaataaatagatgggtgaatgaatgaatgatccagagggcttacttagctagtgcaataataagctcttctgcattttgccagtacagatagtgccagtaggatatttattgacttcagggttttttggggggtgtgtgaggggaggtaggggtgccctcgcttttattcgtttcctgaatatagaagccagatagaatacattggttacttcctggcctcctttaactgcttcttgacttcattaaatcaatcctgggtaggtatagaaacaccttacacttttagcatgccatccactctgctcggctaccagaaagagaccactatagccaggtttgcttactcagagctgacatttattgaaaacttactacttgccaagcatcatgctaaacactttccagatgttatcttaattaaaactcacaagaattgtaggttagtactactattttcccarttttacagaggagcttagggaagttaagtaaattgcctatgatctcaaagtkaagtggcaaagccaaaatccaagctcaagtctggagtgctgaactacttattttatcttatgctgagtccttgtttcctttcccatccttatgatccacattgggcatctttagggctccatctaggctgccgcttagtctggactctggagcaaactcagttccttactctccckcctctggttccaccctctcttctacttgggagctcatagatttattatyccatagatttattattatagagaggtcacaatggccaagcacatggaatacaaagatttctaagacactggtcctgcacatcagcagcttgtaccctattaggrttgatagacaaatagatmaacaattacagagccctgggtaagtgctggcrtctacacaggagacaggagacagtggggccaaaagacctgtgggaaaaagcagttgtgttccctgagcagagccataaaggtctcttggaactaacatccacaatcacgtgtgacacacaaacacacagacagcatttccacttaccccctttcatgccttccctcatttttatctttgatacttcccagaaatctctgaattgcttggcgaaagcagagtaagatatggggccaaatgactcacgtatttttctttattgtaatccatgcttaatacaaataataaagtacaagcaatgcagaataatgtgaaataaaagtaaaagttatccatgatcactacttcaagtgataacaagtgttaatggtccttctagaatttaggtatatacaaaacttttaaaaccaaaatggttcttttgctatgtaagtgktgttttcacattaatcacttcttataggggtcttttagtcagatgtctgtctatactaccattttaaggctacaaaacgttatgtcatatatgtataaagacagcttattaatgaacatttcatgtatttctgatttttcttgttataaatatcattgcagkaaacagcataataaacattgctcacattctcgtttctccctaaaacaaattcttaaaagtggaattgctgagaaagggtgtatgatttaaaagttgtacatttcagattgtcaaagttactggtcttttcctttctgattttggatcttgttgttattcttaggaagaacttctgtacatcaaatttatagaaatgtccttcaatataatcttctatttcacttttcattatttaaaatttcaaaaatatacagaaaagtggagagaataactagatgaacacccaaatrcccatcacctagatttatacattgtaaacattttgccatattcatttttttgtttgtttacatttttttcttttctttttttttttttttttttgagacggaggttcgctcttgtcgcccaggctggagtgtagtggtgtgatcttgtgctcattgcaacctctgcctcctgggttcaagcaattctcctgcctcagcctcccagtagctgggatwacaggcgcccaccaccacacccggstaatttttgtatttttcgtagagactgggtttcatcatgttggccaggctggtctaaaactcctgacctcaggtgatccwcctgcctcagcctcccaaagtgcagggattatgggtgtaagccaccatacccggcctgtttaaatgttttaaagtaagtcacaaacatcatgccagttcattgctaaatgccttagtatgcatctcttaagggtaaagttaggctgggcaaggtggttctaatcccagcgctttgggaggccaaggtgggaggattgcttgagctcaggcattcaaggccagcctgggcaacatagcgagacctaatctctactaaaaatttaaaaaattagctgggtgtggtggtgkgcacccrtagacccagctayttgggaggctgaagtgggaggatcrcttgagyccagggggttgaggctacagtgagccatgatcaatcacaccactatgctccagcctgggtgacagagggagaccctacctctaaataaataagtaattaagagtaaagttattttcctagtcaattgttttcttcctcaaatttgtctcacaactgtgagctcaaaggtcataaattatatagttcataatgtttgtcatactcttcctctgcaaatttaaatacgaattcrcacgtgtatattttgaaatcatacttttctatcttctggaagacaagacagtagttaataagtatttatgatgtttagggccagtgataggcattttatttatttatttttttgagatggagtctcrttctgtcatccaggctggagtgcagtggcatgacctcggttcactgcaacctctgcctcctgggttcaagcttttcttctgccttagcctccmragtagctgggattacaggcacacaccatcacacctgrctattttttttgtatttatagtggggtttcaccatgttggccaggctggtcttgaactcctaacctcaggtgatccgcccaccttgatttcccaaagtgctgggatttcaggcatgaaccaccgtacctggtcagtgctaggcattttaatgtggttttctcacttaattctcctaacaacccagggaggaaggcattgtcatcccattttgtaacccaattttcctttgtagaaataaattaagttctttctattactaagctttccaaatgaccttggattttaaaataaactcaaattggttacttttccattatgcataatgacaaaacccagatagtgatttatatataattagaaggttattttatttagcttttattggccataatctgtatttttccactgtttgaagattttatagtttctgtttctaacttcaagaagaaatttcatagttgcaccacctctaatgtgataataaactcaatatcctcagaacttcaggattttctcctactgtctttagttttccttatttgcttgccaataaacaccaacattaattcttatgaacttaacaaatatgtatagcatattgcacacaaaatcagtttttctttctatgcttttttccctaaatttaccacaacagtaaccacagcatatacatatatgtacatgcatacacacacacacacacamacaaacacacacaaacacacacaagagaaagacattttcaaattgtactgaaaaatattgttactatagaaatccacatgaacatgatgagtacccacccaaatgaaggaaaatcttttgttcttatacaattyagtgaagtttttattatcttattaggcatggactgttattcctcattgactgacttttgaggaaattccattgcttgggagaatgtgagcatagtgttttgtacaaatatcagaggagtatacaaactggcatattcaacctaaccagactcttgttcactcaagttttcccatatttttagaaatcatatgtagttgttctctttagggtataccattgactctaaaataatgggttattgggatatttggaaactcaatggagttcatgttcttttctcatggagaaaacgagagagctgtttccagaagtctttaaaagacttctaagctactttcttatttgctccttaactttttcagtgcaaaaacaaattttttaggttttggcatttgtatttatttgaatttttttacattgactcaccattctttgtggattarggaattaatcagttcaagtgaataaacaatgaaatgtctttaatattctgtagagtaatgataattcagatgcttattgactgcagtgtgtggtatggttttctgtcataatataacatagatgagtagagcatgggctttggtgttaactgaattcggatccaattgtttgttatgtgaccttcagaagatcagttagccttttaaagcctattttcccctctataaaattgaatatgatcacctctatttgcagattgtattgaagaatgtgaaacacttggcacagggaaggggcatcaccaattcatgaaagtatgtygtagtcatttgggtgtcagtatttggtagagttttaagcatacatttttaaaatgtgttatgtttccagacaagtagaggaaggatgaaacattcctacattccttgtttattttcaaatagccagattttagataaaccatttggattatggrgcagattgataatttgatgatctggcattctgtggcatacagctttgaaacataatgttaaataaaaggtagttcacatcaaaagtccagtatgatccctttagttaccatgtaagtctgcttttatttggttttatataccagtgaaaactgaacctgatcttaatagcctttcaggktttytgtttttttgagacagggtctcactctgccacacaggctggggtgcaktggttgcaaccaaagcccactgtaacctggaactgctgggctcaagtgaccctcctgcctcagccwactgagtagctagaagcacaggcatgtggcaccatgcctggctaagttttttagraaagggttttgtagaggcagggtstcactatgttgcctagactggtctcaaactcctgggcttaagtcatcctcctactwtggccttgcaaagtgctgggattataagtgtgagccaccatgcccagctgtctttccgttttaaaataagttgttcaccttctaggaaggtgggtgaatggacacktttgttacatttgttacaatgactgtttcctttttatttagactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggrcaatttggattactaygatgtgaatgaggaggaagctgaataccttccgggtgaaccagaggaggcattgaatggccacagcagcattgatgtttccttccaatccaaagtggatacaaagcmtttagagggtaggatctcccctccagattctgatctgtcctcccccttgcatccaacacctacttattggccattctatcctgaaacagaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgagggtgagtgcattagaaaactgggtgctaaggtttcatcttaaccatgctggttttgcatagcgttgtgatttttctcttaagtgggtaggtgaaaagtttagcaaaaagaagattggatctaatttttaatccctgtgtttcaagagatagwgtaaatttcctttgccaaataaatcttggcaggcagattctgttcggaatctcttgatcattaataatgtttttttaaaatatgggcctcatgaagtgagtgggggaaaactgggtttgttatgccagctacgctctcaagtgtaatgaactatttcagtttgaaagttcagcaaaggtaaaacattttgcggcttcatacacattccagtgatggacgggtttgtgctttttaaagtggtgagttgtgctggctcagatgaacatgccagattcatactctgttgtgagacaagcctagcgcttcycttggttggggagatatgcttgtgatgtgtgggagaggagagcccacagggaaagaaaatgactaaacacctgtgtctgttgtcatttctggttcatggctatgcagctgtggcatgaacctccctggagccttgtcctcatttcatgacccactgatcggactgagaggcgaggagggagatggcgaaagcaggcggtggttaattatcatggacatggggtctatgtcagtcttctagtccttgttgagacttgtcatgccagctgtttcttccccatcagrcatggaaagatgtgaatgggaaactgactccagattgtttgttccagggactgctcatctgacctctgataggaagaaagaggtcagaggtgactgctttgttctgaatctccatgtttttccaccttttctgtttcctgtcactgttgtggcaaaaacatggctgacctagcagagagggccttctgggttctgctctggtattatctgcaggctattgcatggagaggtactaatttcaggagggaagaaaatattttctgactaatgtggcattgtgtaaggattcgagggagtacaytggtgtcggcttcgagtttgaatcctggctgccaagcttgctgggtgacctgaagtaacttatgtaacccataagcctctgatttctcaggaattacttgggaggattcaatgagacagcgtatgtgaagttcttggcttcgtgtctgcactcactggttcttaataaatagtggctgctgttactaattttagaagatttaaaacagtgggaatggggtggaggatgggtagagaatgaagaatgtgcttattaaagagtttcacattaatttgtgcctaagggaccacatttccatgaagttgaagatgtaaattttattggaagtctttagaaccttcagatccttctgagaatctccagaatttacagtatgagtttcctctaaatacattttaaggccaagtatcaaagattttcacaaagggatttgaggtaaagaygcattcctgaatggccttctcatttgtgggttgtgatttccttccctgggaagagcgtgggaatattaaaaagcagatctatggagtcatgtattaaagggttaagaagggactgcacaccctgcttygggctctgagagcttgagatcactggagtaaagtgcaggaggcttcaggaaccagccatagagtagaacagaggcacagctataacccttgtggggcatgaactatgatatttatcagctgccggatgcagtctactatagacatcctggtaatggcaaaaaacgcctgtgaaaaagctggttaatacgcattttggrggaagaaatctagaagtgtttgaaacttagacaaaaaaaatccagtttttgttttaaaagaatttacggggatgtatgaagtatagaagcatgcaattgttaaatacttttgaggggatgcagtgactgtttctttcacataaaacattggaggctcagaggtctgtctggtaagtgtgggcttcctccgggaagctgtggggtgggagtggcagagacacagaacattgtccggtactaagtacccagccatgtggcatctgcctggctttttctgctgatggaatagaaagcacatggttttggtgctggttggacttgaccttgactcccagctctgctatgtggtttggggcaagacatgtagtctgtttgacccttggctctcctcagctctaaaacagagttaatgaagacctcgtcatatacttgcaagaactgaaattgagcttgggaagcaccctgcccaatacattttagtttccctttgaagctttagggtagtcatcttgctaaaccaagaaattaagatttagttaaaggcccagaaaatatcactcctttttacatttttttccccttagggactcattttacagacctttctttttgttcagaaatttagattttcagatcatatctacaccaggcaggaatgtcctggccacactcgagctctgtcttcctaggccacagaacagcagtagatggatgtgcaagcatgctttctctgaggagtcttgtttccagggagctctggtcgttttgttgtcaagtcaaaaagttacccaagcacctgccgtgtacctgtctctgactcggtgctagtggaagttttggctggcatttgctaagygcagcctgctgctctaaagtgagaacttggcattagattgcattatcacagttagtcctcagaattgccctgtggggagttcgagaccagcctgggcaacatagggagaccttgcctctataaacaattttaaaaattagccgggtgtggtggtgctcacctgtggtcctagctactcgggagactgaggtgggaggatcacttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatgaagaaattagagaaagctgtagggtgacagagagtsaaaggcactgtccaggagtgtcactgctgttggggaagtctttgtgaggaaggaggggcttgagccaggcctggggtcaaagtctgagagggagaatgtgtgaaaacattatgaacagagaagtgacaagagcggagttgcagagatgggaatgaggagggaggaaaggagggagagagacagagacaaaggttgattaaggcagtggggtgagagagttgccagtgagggcttcagytgcctgggaccatgggactgcctgtgttgtgagtagaaaggaatgaggtttactgataggggtcttagttattcttaagcctgctgaggcagtgctatacgcagcttaatttaatctcaatctgcatgatgagttaggaggaaggacacctggctttcagaaacctcatgtagtcccactccacttttggccttgtgaaaggctgcaggagtgtgttgcaagctcaacttccaccctgagaagaatttaagcaggttctgctgccagtgcaaccctccaggtgccaaagaccatcccctgggtgcacctccaggttgcagagggtctgtgaccaggagccgccgccccccsatgcctgtgaagacacctatatgaggagattccvtggtagggcccctctcccttcaccagaagtggagagagcctgttagtgtcatgccagcagttgtaaaaggccacccccagggtcgtgatcactgccaccagcatcattacatgccacacacatcaaaattaaacaaacatgaaaactggacgaaaaagcattccactgtttrttataaagttggatatggtttttctaactagtctgtcattctgagagatgggaaaacttagaagaatttttcctgcggtgaaaatgactttttttttttttgaggtagcagtaaaaattgttagtagttgctccagctgtcctgaagcagccctgtgcacgaagcctcctgtgtccctctgtgttggcccagtgaacccagtcgacaccatggaacctcccstgtgtctggsccagggccttctgtgaagaagggcaggccggccaagggctgcagacaggtgcttaagtgtttctgggaaaatgaagattgaaagatggctcagaacaagtgcagaggagaattttccatttttgttacgaactcctagttaggacaagtctcaagtcctttggcagggcatttctttctttcctctgatatctccccaccccatttttctttctattaaggacatgagaaaagttaaaaacaaacaaaaaaaacattaaatagaaaaaaaagagatttaaaaaatcttcatgttaagaatcctttagcaactatcaaacctcagttaacaaatccatgacaaaatgagttcattcaaacctggccagcctccaccctcctgctgtgccctgaggtgtcagcaracttctttatggtctgactctccgtggcaggagcttcctggcakagtgtgggtcccagaggaggccatggactagaaactgtatttctcaaagtgtgggcactcatccaccttcctctcactcagctgggagcctggttaaaaacactgatttccaagcgcctcctctaccttctgaaccagaaactgcatttttaagccacctcactccttcaacacctccaggcctctgcccaaaygtctyyttctcccgaggtcttccctgaccatactatttcaaagagccaggtgygcctgccctctctcaccctctkgtctgaccctgccatattcctctgcacttcagtgattctgatgccccctcaatttgatgggatttagagccagaagattgtttcatctctgtaggcctcaattttctcatttataaaatggagatatcttctaactagartaggaagaagtgcatgaaaatacactcaaagccatgatagggacatgmaaatgaccaccgaaaagaaaaagtgccacttttcctcgggtgkgtttatygcacatctcatctagctgggatccagatcttgattcccagccttcaagaagttcagcctctttgaatttcactgcaattcccatagaaatttgagcagtcacgttggccggaggtctggcttttctcgccctggataaatagctgcacgtgggctcagcaccgttctagctccaggtctcccccttcttcagggaagggctatctggctgctgtgcgtctgtattacyttcactaaagaatcttcacgttgtattcttgtggatggatgcccaaatgggccgtaagcactgagctcrgcttctcaggtggccagaaatgagcacgagaaatttcctaacattctgcccacccyaggagctgccaattggtcagattaaatttgttaacgacattgatgagcaacacctagctcagaaatccaaggcttgttgtatcccaagccttctatcaacaccaattggtgtgagaatcactkgcggggtggctaaagtgtagattgctaggatgcacccagagagtggaaytggtaggtctaaggtgggccctcagaatttgcatttttaacagaaatctcaggtgatcctgatgcagtggtctctggaatccaccgggagaaatgcagctytccgtgygaaggactgcatggtgctgtgctgagggtgtaagttgttattcaccccttggtgaatttccttgatgcctcatgctgttgtcagaactgaaccccacaaacctgctcctcctcagtctccctatctcagtaactggcagctccacccttttggtttcccacatcaggactgaacatcatcccacatccagtctaccagcaaaccctctcrgttccaccttcagaatatcccagacctgggcccttcttatcccctgtaccagcacttcttaccaccaagggaccagctcctgtctgatttactgtagtcggagcatgttactcttctgctcgaaaccctctagtgcttcccatctcactcagatgaaagctcaaatccttcctgtgatctctgagaccctgcatgaatgacccaggccacctcttctctcaccatccctcccacatgcccacacacccctcctgcctgacacagcaccacgcctgccctcatctgtggggttcactccctcacctcctcctggcctctgctcagtcaccttctcctgaggtcttccctgaccatgctattaaaaagagccatgtacacctgccccctcccaccctcttgtctttctctgctgtatttctttgcacagctcttacacatccaccccactaagtaatttacttgtttattgactgctgctggggagaatgtaagcttcaggatgtgaatttttgtctcytttgctccctgccatgtcctcagtttctagactaggtacaggtctatagtgaatgctcagtaaatacttgttgaattagtgaatgaatgaacaaaaattgtaagaagcatttacctttcacctaacaagctgccattgtaaatggtaagtgtgcaaacctgtgtgtgcacttgggtatgaaggcaggcgtggaagagggattataaatggaggcttgccttcccccggattaggggctgatccatcttctttccttcatgtggctgttatgaagctgaaagagacagtgtgtgttcttggctcagtaagtaccatcctaaaaatacaatattccacaaaactgtttaaaaagactcccaggttagcttaacagtaactagttagcccattgtaattacagtttaagtctcataatagcctttcatgggagcctgctcattgttataacttcttttyctgtaatagaaaaatgtagtacagcttccaatctatttataaacctttgcacagttgcamttgtaagttgctggctgcatyrccctgcctctttttacttagataaaagctatgactccacctagtttaactctccatatctagactgtctctcctccatcttctctctccttgtttcataattcagcctyagaataagaattgggttgcagaataaggcttcacaaaataactgaaataagatacaatccaagcctgttatttccttaatttgtgggcagaacagcttgtaaagtttggattgatttttatctgaatattatgaaaacggctgcttttttttttttttttttttgagatggagtctctctctgtcgcccaggctggagtgcagtggtgcgatctcggctcactgcaagctccgcctgccagattcacgccattctcctgcctcagcctcccgagtagctgggactacaggcgcccaccaccacgcctggctaattttttgtatttttagtagagayggggtttcaccrtgttagccaggatggtctcagtctcctgacctcgtgatccgcctgcctcggcctcccaaagtgctgggattacaggtgtgagctgccgggcccagccaaatggctgttctttagacctatagcagattgcctttttacttggtgttcagaagtacattaagaagaaatgcgacttctggcaatgcaggggtgaggaagaggtgttctacttawtttagagatgaggaagctgaaagacacagtttgcayagtttccacaaagcccccgagggagggctgaggttgagtcctagagcttggcgctttctgcagcccctcattccttgagctctgggagaaagtcctgatggsccytaagccatgagcayactggtgagtgtgtgagtccctcctgtagctgcttccttacacttagttgtgaatttctgagctggagaaacctgagattttgacacatccaagttacattcatttccttttactctaaatgtttttttccctttcttaaactaatagacagtgatacagttttcttcacagccatctattttaccatgatccatcctgggtttttttttttttwtttttctgccttgagttttatatcacttttctgtttaagttaagcttgtcactttcttgtttaaataaagttgagtcatgcctaattttctatttttatcaaactggaatttcttagccaagtcatcaaggccctatactaaatcttgagtcataacttcattcctactatgttctaatcagattttccacttgaacctacactgtctgtcctgccaaccctcagcttgctgctttcccaaggatctgcaggcagcactccagtactgttcaaaagctaatgccgctgctgctactctcatttcttacctgtgctgtttttcaacatgctgtaatagtcatctcgataatcttccctgcttgcttctaccattaaacccagtttataaagtatgactcraattatacttgaagtctgtgctgattaaccccagacatgtgrtgacccctaatctagtgctcatgatctccgtacttggatcccattgaaggggtcgtggagagtagcagttaagattctccagctagatgtcctaggttcggttcccacctttgccactcactgcctrtgcgacttcaggtgctttagtctactgtgcctcagctttatctgcaaacgggttaaaaaattgtccctggccagagtggtggctcatacctgtaatcccagcattttgggaggcctaggtgggaagatcacttgagcccaggagttcgagaccgagaccaacytgggcaacgcagggagacccctccccccaacccaccctaccaaaaaataaagtaggcaggtgtgatgcatgcttgtggctgcggctactcaaaaggctgaaataggaggatcacttgagcctgggaagtcgagctttcagtgagccgagatggcaccactgctctccagcttgggtgacagagcaaaaccctgtctcaacaacagcaacaaaaaaagtccctgctacctagggttgytgtgcaaattaagagttgttggccgggcggggtggctcacgcctgtwatcccagcactttgggaggccgaggcaggtggatcacgaggtcaggagatcaggaccatcctggctaacatgrtgaaaccctgtctctactaaaaaatacaaaaaattagtcaggcgtggtggtgggtgcctgtagtcccagctactcaggaggctgasgcaagagaatggcgtgaacctgggaggtggagcttkcagtgagctgtgatcgtgccactgcactccagcctgggcgacagagcgagactccgtttcaaaaaaaaaaaaaaaaaaaggttgttaaatgtaaagcttgtatatgttaagcgcgattgaagtgttaactttgttatatttttatttgctgatggaggtctttatcttggtgacattgtacctataatgctatgtctcattagctcctttactttctgttctccctgggaatactgggtaaagattgatctttggatttcttcctcccctcctgtctcctcgtttccagatagacctggaacacaactaccacttggtttttcctaagagtagggtgggtgtcctccttcatgccagcatccgtgtctcacactagaattccatgccatccctgctcaacagcatgctcctggagtctccagccaactccacctcctggggatgtggaggcagaggtgtgtgcagccgcttggcctcctggtggcmatgcttgggattggcatatttcctagtgccccggagaaagcaccctcctgtccatccacaaccccygccacaccctacccccttggctatttcctttatgaactatggcatttgctcyagtttccccatttctttgcagcacagatggccctcttcttttaatgggcagaataagtaggaaatggaagaaacagctgccagagcactgaatttatcctagtcctccataatttcttggaagatctgcgagtggggcccaagctgtctgctactgcgtggaaatcatgcttgtaccatacccatcatagttaaaccctgccaagggcatagggcattttaatagcttgaatccctgttgttttgcsmtcctctgtccccttctccccatgccttttctttgaggtaggtgcgtgtgttctttaagacccttccctcaaaacaatcttggtagcgagaccagctattatcttttttaagttcagtgttmcctaaaagaaggatggttagacataagacatttgttagcttctctattatgtcttcctctcaggatgtgtttaggttgaaccatataaaagtgctgatatttagcccttttkgacccacaaaaatagtggtttcatgaagttcaacctaacatgwacttactggtttgctttcattttactgcactcaaacccacgggtgcagyctcatcttagttcaccaactctgcaatgrgacccagccgggagcagtaagcaattcttcttgccagcagacaaagcagattaattcccttgggttgaaygttatgccggtctcttaaacatcaaaaactgtttgttatgatctaaactgcttctatggagcagatgttgtgtccccgatgcagcagtgacattggaatcatttagtccttttaaggcaagtttgttttatttttcagtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgarggtaattgactggggcyrggaactcctgtgtgtctattcctgctgcttacctgtttccagctaccactgtgagctctgctttatggaccaaacatctccactacttaaatcagagtgctatcaacttgcaggtgctcaataaatgtgtgaggaatgaactggtttgggctgattcccaatttgaggattatccagaaatgcttccttctgccagctcattagagccaaagtgtagtggagagaaggaggaggggagaaaacagactggaggcaggactgtttcatagatggataattggttggttaggaaatcattaaagtgacttgctaaagagtgagttttggaagttgtcagtggaataattatayctgggtacacccatctctagccaggatgaygtccaagcctaactggatttgctgtcttttaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgakaacggcttcagcctcgcaggtgagtagggcctctgagaaggccggtagtcagcattgctttggcagtggtgctccttggggcactgtctttaggcctttacgcagtgacagaggaatcacttgtttaatgtactagagccacatgtgtgtagttttctggccasaggttgttgggaatggtttgacctcacatcactgatttttgaaaggcagtgatttcgtctaaatgttctcccagctgttctgagaaacaggatgattccattcagaacatttgtgtcctcttaccccaatttgttgmagcatatttgtcaggctttttaaattatgcacagatctgtcaaatgcaaaaatggtacttggggcacctggggatgattttacttcatggggaaggggtgctcttctcctcccagctccacaacctataatagtataggccggtgcaccccagacttgaacctgcacacacatcacttggaggtcttgtcaaaatgtaaattctggttcagcaggcctggggtggggtccgtgattttgcttttctaccaagctaggaggtgaggtaccagtgttgctggaaaggccacccgttgacaacaaggatttagaagatactttttggattctcaccttccaacctgaaaacttgtttgctagaggttttatctttattgcattaaaaatagttttgtgagaagttctttctccatctttaactgcagagctcggtagctgttaataggttcttgctttaatcaaaatttgaataaagcccttgggtcaaaagtagataaaaaatggcacacctggataaatttgtatttcagataaacaattttctagtataagtattacccacatatttcatgagacatacttatctgaaattcaaacaaaaccctgaatgtcttaggtggtagtttatttgtttttgtttttttgttgttaggtttatttgtttgtttgttttttgctaagtctagcaaccttagagaaaagtcaaggacgttcccaagagtatttctcacagaatacaagcttgttcaaagagaagctgggtgaggtaaggcaggatgaaaccatattcttcaatggaaaagtttgggaacttatggaatcaacagctgatagtgcttactctcagatatcagataatctccttaggcacgatctccaacagcagtagaaattgggagcgggcagtatatactggtaactgtttaagcaagacctcttttcatccctgtgctgaatgtttttcatctccaggtgctgcctttacccatgacatggaagttacattctacccgggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccagtatgtataaccagtcttcacatctgtaaaatggggattatgcccatctcacaagatagatacaaggcttaaatgacttacatggcatgtccttagaacagtgcatggaacataaaatgagctctattatgttattactcttattgttaccatgaaatatatyrtgtaagtgagcagaatggctgctatacataagaatatctatatccctacatagtattttcaaayaataaaatcaatagcaacattgtccatggggtgggtagggatggtataattatatacagtttttaaccatcctactttctgcaacatggaaaaatagtgattattggaatttatatttatctcaaccttgtttcagctgatgagttcaggctgctttaaaaaaaaaaaaaatcacagaaagaggccaggtgcaatggctcatgcctgtaatcccaccactttgggaggccaaggtgggtggatcacctgaggtcaggagttcaagaccagcctggccaacatggtgaaaacctgtttctactaaaaatacaaaaattagcagggtgtggtggcacgctcctgcgatcccagctacttgggaggctgaggcaggagaatcatctgaacctgggaagtggaggttgcagtgagccgagattgtgccattgtactccagcctgggcgacaaagcaagactccatctcaaaaacaaaaccaaaaaacacagagatgctataatttattataaaactaatgctagatttggagtcaaaagataagaatttatatcctggacttgccatttaatatctatagggaaaggcctcttaatatctgagaatgtattttctcatctttcacatggaactaaaaatgctttttctatattatgtgrtcaatgtgtgcgaagcgtgatgtgttctgtgaaagtactacctgcgcacaggatgctgcctccatcacagctgctgttgtgcagcacagcaatccggattgagttgtgcctttcctctgacccctgctgctcctatgctgagagctggcagcctggcaggagatgtagggaagacaaggggaagcagagacctgggctgtgaacaaaatggtcagtgtccggatcactgacctgagcttgactcctagactcagatggtgagagacaaccctttcccttctctggaatccttcagatttactgaagtgmgaggtgttggaagtcgtcacttctgtgaaatgtagaagatggattggtttaaaatttagggtgtagagtcaaaccaatgtgagtttcagttccagctctaccatgtrgcagcattgcatcttaggctacttaacctttgtgagcctctgatcacatgatttagtgcccacctcaccaggctgttgtgaggaataaatgaggcagtatgtagagagcactgttggcatggctggcccttagtaacacttattctttgtgtataataacwtggacaattgtagtgccttctccctctcagcactgtggctttgcatccactcaggtttttgggatttccttasacattttttcatataaactcaggargttcccaagggaacacactccaagaattagatgaaaaamwctgcagaaaaatccacctcacatgaaaatctctgtatttaatatttttaaaaarttaccactgtgtttgttgcagctgtgacctctacaagttccagagactactctctgacttttggtgcaatcaaccaaacatggtcctaccgcatccaccagaacatcacttaccaggtgtgcaggcaygcccccagacacccgtccttccccaccacccagcagctgaacrtggaccgggtctttgccttgtataatgaygaagaaagagtgcttagatttgctgtgaccaatcaaattggcccggtcaaaggtaaggtttccttttttgttgttgggtaaaaatgacatccttttaagtagagttagaatgattcacagaggttactaagggttacctagygccatgctgtgttaygtgctaggtataaggatgaatagagcagatccttgcccttgagttggaaacagaggcagaaaagagttttagggcagggaacagtgtccctgccaaagtcaggaaatagagcatagtatgtgaagcyggtttatagcaatacccaactgtgcgtgccaatcaggaatatacctgtgaacaaggcagacyggaattaggagggagagtgatgctgacaagtatttgttacaagtgtgatgagagcagggcactgtgagtctagtttgaagattcagaaaagatgtccccaagaaagtgacattttagctaaaacagatgagaagaatttcatccaaaactaaggtggagcaaagagctagtatctggaaaaaccaaacatcatagaacttgatgtataacctccccctccatgattcccagaacattatacttaatggtgaaagactggatgcttttccctgaagcttaggaacaagacaaggatgtctgctgttgccacttttattcaattcagtactagaatttctagccagggtgattaggcaagaacacaaaataaaagccatctaaattggaaaaggacaaagtaaaattagtctcagatgacattytgtgtagaaaatctcaggaattcactaaaacactattagaactaaagaacaagttcgcaatgttataagatatgcaagatcagtacaccaaatygtatttctctatagtagcaatgagcaaactnaagattaagaaattgtttcaaaaagagataaatttttaaaaagaagtgcagtacttgtacaytgcatcccacaaaacatttttggaaaaaaatttaagacccagttaaatgggaagatgttccacattcatggattggaagacttaatactgttaagatgtgaatacttcccaaattgatctattaattcaacataatccctatcagaatctcagctggctctttgmagaaattggcaagctgattctagaatttatatggaaattcaaagaacacagaatagccaaaacaatcttggaaaagaataaagtcagacttgtatttctcaaactcgaaatctagagtaatcaagacagtgtggtsctggcgtaaggatacatgtaaagatcaaaggaacagaagtgggaacccagaaatactcacattaaaagtcaattgctttttcaacaacagtgccgggagtggggagggatagcattaggagatatacctaatgctaaatgacgagttaatgggtgcagctcaccaacatggcacatgtacacatatgtaacaaacctgcacgttgtaaacatgtaccctaaaacttaaagtataataataatagaattctgatggttaaaagmcaaaacaaaacaaaaaacacagtgccaaaacaattcaatggagaaagaatagtctyttaaactattgttaactatggtgctgggaccactgagtgaccacatacaaaagaatgaagttgaaccttttacctcacagcatatccaactcaaaatgggccaacagacctaagtgtaagagttaaaacttttagaagaaaacatatgggtaaatttttgtgactttgaatttgctaatggtttcttaggtacgacactaaaagcacaagcaacagcaaaataaactgggtgtcatcaaaattttaacagtttgtgcttcagaggacattattaacaaagtgaaaacacagccatagaatgggagacagtattttaaatcatgtgatatttgttctagagtatacgaagtactcttacaactcaataaaaaaacaagctaactaaaagatgggcaaargctctgcaaggacctctctccaaaaagatatacagatacccaatgggcatgtgtaaagatgctcagcatcattagtcatcagggaratgcaaatcaaaaccacaatgagatactactttacatcatgtggtcgagtataatcaaaaaaygggtaataacaagtgttggcgagaacrtggaaaattcggaaccctcatacgttgctggtgtgattrtaaaatgatgtggctactgtgaaaaacaaaatagtggtttctcaaagtgaaacacaaagttaccatttaatggagcaattctactcctttctatatacccaaaagaaatgaaaacatagatccccacaaaaacttattcgtgtatattcatagtggcagtattcataatagccaaaaggtggaagcaacatacatgcccatcagttgatggacaccaaaaaatatattcatatactggaataytattcaaccataaaaaggaatgaagtacrgatacatgctgcaacatggatgaactctgaaaaccttaagtgaaggtagtcagtgacaaaggacagcatactgaatggttacaattatgtgaaatatccaaaataggcaaatccacatacatagaargcatattcatggttgcccagggctaagagataatgagagcatagggcgttaatagctaaagggtacagggttaattttgggggtgatgaaaatgttctgaaattgattgtggtgacggttggataacactgaatakackaaattgtttaattatgtactttaaacggatgaattgtatggtatgtgaattacttctcaactgaaggccaggcatactggcttatgcctgtaatcccagcactttgggaggctgaggtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatktgtctgtagtcccagctactcaggaggctgaaacaggagaactgattgaacccaggaggcggaggttgcagtgagccaagattgtgccatcgcattccagcctgtgcaacagagtgagactccgtctcaaaaaataaaaataaatggaagcaaatastagtagaaacaaaactctaaaaccattctcatcgggtacartggcttacacctgtaatcccagctactctggaggctgaggtgggaggatcacctgagcccaggagtttgaggccagagttggccacataacaagaccccgtctcaaagtaagcagtggttctcaaatttyaatgaccattagcctcacctgtgaagactgattttaaaatgttctaggcatatcatgtcacagaaagacatgcaggaaacttaaaagcatgttgctctgtgaaagcagctagtctgaaaaggctacatacagaatcattctaaccatgacattctggaaaaggttacactatagagacagtaaaaagatcagtggttgccagtggttcaggaggaagaaggagaaggatgcataggtggaacatgggatttttagggcagtgaaactattctgtatgatattgtaatgttggttataggccattatgcgtttgtcagtctatagaactgtccaacaccaagagtgagccctactgcagactatgggcattagttaataatgtgtcagtattgattggggataacaaatgcaccacactaatgcacaatgttgataataggggaaactgcacattttgggtggggggatatgggagctctgtrctttctgctccatttttctctaaatgtaaaaccatcctaaaaagcaaggtcttaattattaaaaaatgtttcaagcaagccagaggatgagcttgtgaagtcagggaactctacagatgggaagtggctttgtcagatcaaggggacattttaattctgaaaaccaggtcatgttttcccctagaatgtaagagccacaccaggagaaaaaaaccatcttcctcaattcagccactgtattgaaactgttgagcccagagttagctcctcagtgaggtgaatctgtaagtgataygcggttctgtgctttgttattggagctrarggctccttaagcctcagcaggctcaataaagaagtgttgcttcagcaatatgacaagattaaggtacaaggactagactcttttctaggatgcgaaagtgacttgtaatgagaatcccgaggtgctttggttttaagaaacttggttgggaatgtaggcattaggtgcccagakattggattgtaaggtagcaartgaacacatgaaaatgtgagttgattttagaggaacatgtaaattagaaagggaaagattgctgtagtagatttctcaaagagagatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttccyagagacataccaaatgagagtaagaaaggatcagagaaagcaaactggcaggtaccaagttgcttgttttctttagaattttatgattttccctcccaccccagtcaaataataatatcaaagsatggtttacttggtgccaagtactgttctaagcaccttacaygaattaactcatttaatccccacaatgacctctacccaatggtggggtgggggtggggttatttgttatcccattttacagaygatgagactgaggtatagaaatgaagtaatttgcctggtcatagtaagtgacctgggtgagctgggactcaaactcaggcactggctccagtacgcacacccttacccctcatggctctgctgttccacagtggcctcatgactgcctcataatttagaccaaactttgaaagaggcaatgtgtgtcttttaaaccctttgtgtttgaaccctacttcatccacacacagcagtactgttcattctacctgaataggagggaaaaaaagaaaaacaaaaaagaaacacccaaaagttttttctttcccctcttggtacacagcagtatcttcctaagaactgctcagtttttccagagggaactatcatcttgttggrattcatgtgaaacagcgcagctgyccacacctgatgtgggtgtggtgcgacttcccagggcgaggatgcagaactggggtgtctttyccagtgagtaattggagcctctgtccctcggtgacttctcaaccagcagtgccaccccccacyagttgtttgagctttaagctttaagtgtgagtcagctgttttttgttgttgttggttggttggttgttttgtggggtcataaaacacgatccaaaaatgcttcctgtccttccacttcacgggtccttttggcgagttgaggaggctctgggcagagggctgtgcagtgaagctgaagggactgttcctttaaggaaaaccgctcttccccttgattaaatgagtaaattagttccagatcctctgttaagagagtcaggcagtttaagagggtgagggcgaaatagaaaatgtcttaagaaggatactgtgttctttacttactataataggagaaaagcttacaagtcatagagaatgagtcgtgaaatggttttagaaatgtattttaaaaatgttttgggaagccaagttcagtgaatggggccctgtgctcagaagagccccatgcttggtttaacgctttgctttgamccatgggctccacattttcattttgcactggggattgcaaattatggaactaatcctgtcagtgacatacattttaaatcagtattgagtaattagggacactttcttctcaattttaggtaggataatatatcctgtccaagtttgcaagtcaacttttgagctgagattttttttttttttttttyttttaatgcctagcagggtggtaagctcttgatgtccatgtgaacacactaatctttgctggaaygtgccatggtgaaattttgatgctggaaagtactgaataagaaggctwagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgargacatgaccttgtccttagttataacctattgaggactgactcaggaacctggtctaggctcaagttaactcggcaaccacaaccccagtgcrgtgcctctttcctgtcagysaagagatccagaggaacggacstccaaggatgtctgcatgcttcagggagctaggcttatgctgacatagttcatcaggtttaaaaagtgctggaattatttattggtcytttgttttggcaaagattctgttactccagccracaacattgtggtgaactgaggataaacccatagccctccttattttcagccaataatacgggaatcaataatacgggaatattccactacaagaatgcactgtggtgtttcttataaagtgggatggaaagagtttaccagaaaacaaggctgtctcagccaaggcatcccagctcacagcaggctatgacagggcactggaagagccataacgtgggcagtagggcaggcacgggggagaatgccagacacccygaaggacttgggagcgagtccagtctatgaggtcagctgcagcagtcagcacttgggatctagattaggagtcactctgggcaagtctccccccatagcagtggggttgtggttgccaagttaacttgagagtatagaccaggttcctgagtcagcatctgttacaatggagaacaacagggtcatgtcctcattgaaggctcagtataagacaagaacctgattctctcctgttgttatttctccattttaatagaagattctgtacaaagtggggtgggagacaygggtcagaaagagtgaaatgatagagaatccaggaggaggtggtaaaatgggtggtactgccagtgtctgcctacagatgccatgatgctggtgtctgtgagtagtgagaactggtgagcaggatgggmctcagaggatgctaagctggctatcaagacagggcctcaggcacagaagtatgaggcagaagcctgagttattacaacttagatggatctccctttgtagcagaratggctcaatgtagaacctgacaggcttagctggggctctggaaatcttttgagtctaagattagagttaattctagggactgaggttgagctagaacctcaaataatgatgaacaktggccccactgagaaggcagaaggagtgcagtcagtagagactgggtagacctgccaatggggaattgcctttcaaatatgttctgttgggttttcttaattttctttagcaggattggcagatgtacatgttcctatttccattttacatggcagactcagaagtacacagaagtgccagagktgatagattcattctacctgagcatctgacactccttccaatacctctgtgccattggcttagactagataacttcatgaagttccttcagtgagggttgcagcaaagcggtggaaagcatgagctatggaaccagactgctagactttyattccagctccatccacctcttctgactgtgtaaccstgggcaggttatttggcctctytgtgatgcagcagaagtggagatagtattttcctcaccatgtagttagaaggatgtaatcaggcatcctcctatctgtttagaacaatgcctcacacataactgctcaatgagcattgactattatgtagaaataaatatatatattttaagacatggtcctgttctgtcacctaggctggagtgcagtggcacaatcatggctcactgcaagcttaagctcctgggctcaagtcatcctcctgyctcaccctctggagtagctgggactacaagcatgggccaccatgctcggctaattttctttcttttcttttccttttctttcttttctttttctttctttctttctctttttctttctttctctttctttctttctttctctttctttctctttctttctttttctctttctttctttctttctttcccttccttccgttctttctttcttttctttctttctctttctttctctttctttctttctttctttctttckttctttctttctttctctttctttctttctttctttcttttctttctttctttctctttctttctttctttctttctttctttctttctttcgagataaggtcttggcatattgcccaggctggtcttgaactcctggcttcaaactatcctcctacctcagcctcccaaagtgctgggattacaggcatgagccaccatgctcagccaaaatagatttctctagggragatttcagtygttaagtaatcgctacctagtgagtagatggatccttggtaaggctactcctgaagagtaaatactgggaaagtcattcctgtttagtcttagaaatctttaaaaarcaagatttttaaaattaattggatttacctataaaaattgggaattttagtaagagatcaacagatttagaaccaggaagttggagtctgagtctttgctgtgccacttcctgactttgtgagcttgggcaatttttcccatgtctcactygatttccttatctgtgaaaattacacataatggggamaacaactcaccacatagaatcatcccaagaatcacaggaaataatagagcaaaagcacttttaaacagatgttttgggcgtttttattccctggatgcaaacctactgaaagcaagtaaaggtactagttgtctatagkgtaggcaataggaagccatgctggagtttaaaactgaagtgcagaaaatccaccctagcttcagatatggataatttagtaaggtcttcmggtgtgtcacaaaacacagacatgcagtcagttccgaggactcctctatctccgtgacatttgcttaccaatagccagattgtgcttttatttcccctctactcatgcagargattcagaccccactccggkgaatccttgctatgatgggagccacatgtgtgacacaacagcacrgtgccatccagggacaggtgtagattacacctgtgagtgcgcatctgggtaccagggagatggacgkaactgtgtgggtaagagccatgttctcstgtctccttcttgtarcccttgtttttcctctgccctccccagccttatgtctgtagaagacaagtatctgtcacctttacaacctccattgtcaatgattttagcagctgttaatctgaatatagttatttaaaaattaaagcatagctgtttakgtttgaaaagatggtttggagtggagtggattttgcaccggggctgtgaaaagaaaacatctgttgcagttcctggatgttttgagttaagttttgtaattttgagcttttgtagtaagtagttcttagacttaccaaaaagcacattttctgattttctttaaattttagacagacattgtgtgtcttatatccccaaaaggcaacggtagaaatttcttgatattaaaaaaaattgttggttttcttccaagtatccattctttttaaaacagttaaagaattcttagaatattcacttaaaaatttatcttcctgtggtgtttacttgaatggcatgaaatttttactatttctgattatstgcaacatgcattcatatctgatttttaaaaattctacatctgccaaccatttgtcccattgaagcatcatactagtgagaaaacattgartttttagaccctccacttctgggacccttgaattaagcagaatttttctcttctcatttcttcttagatgaaaatgaatgtgcaactggctttcatcgctgtggccccaactctgtatgtatcaacttgcctggaagctacaggtgtgagtgccrgagtggttatgagtttgcagatgaccggcatacttgcatctgtgagttccaaaatcattttcctgtgtggccaaaatggtgctctttaatcttgctctttaatctrtcagtgttttgacttctgctattcagaggctctgctatatggttttcttaagaagacagtttacatcaaaataacccaaagctggctggatgtggtggctcacgcctgtaatcatcgctttggaaggctgaggcaggtggatckcttgagttcagaagttcgagaccagcctgggcaacatagcaaaaccccgtctctacaaacaatacaaaacattagccaggtgtggtggcacacgcctgtagtcccagctactcaggaggctgagataggaggattgcttgagcgcaggaggcagaggttgcagtgaactgacagcatgctagtgcattccagcctaggtaatagagtgagactctgtctcaaaaaaamaaaamaaaamaaacaacaaaatctctcaaagctatggctcagtttcagccctgtttattttcactgtttttccctaaatagatatttttggtgttgagttattgaaggatgcccacctcagttgggatttctggcccagtcatgtaacaagatgatgaacttcactagtaaacayctccagctctttagatagagcctaaagtatttttcaaattrgaagagatggatttataattcactgatgcatgtcctacttgactggctaaagagctccttctgtaacaaattacctcttctrtatttccagaaaatactacagacctaaaaatggawcaaaagaactatcccaattcatcccattgataaagatggatgagagtaaagaaaatgcactctttagccaggcatggtggctcacgcctgtaatcccagctactcaggaggctgaggcaggagaatcacttgaaccagggagttggaggttgcagtgagccgagatcacgccactgtactccagcctggcgacagagtgasactccatctcaaaaaaaaaaaaaaaagaaagaaaatgcactctttaattcagtgggatgagggtaaaagtrayaggagaaactgcktgtgtgtgtgtgtgtgtgtgtgtgtgtgtgtgtgtagcaattgctctggagtgttataaactttaattgaggactgcttaggtgatgggtttttgtgcttagtattttaacagcaaattcataccagtacttgaactttaatagcatacaaaccatctaggaatcttattaaaatccagattctgaatcactggaccttgggtagggtctgagaacctgcattccctggtctgttgctgttggtctgtggatcatgccatgaggagtgaggctcatcctttgcaggcctaaactstggatgcccttatcttcttytcttttcagtgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactggtgagtaactgcaggtcagcctcaatgactggaaagttgctttggatgcacatccccacatagatggagctctcccagaaaagacaaaggacttcctttgactctaacagccttgtggctgccaaaatagtgagaaaaaagcgtcctttgagttagaaaggggagccaagggtgatttcctctggactagatgggsgagcatatatggcttccttggcggagacgttcctgtagcactcgggagcttctaaccttggttccttggagccagcgcaggctggaggaatttagggaaagttgcataccttcctgttaggcggtctccaccttaattcaacacttatggttgtgctcttmtgctttaagtgatattttaagcaatctctaaacacatatgtaatttctaatttttctcctctttcaaaagagagaactccacatatataaaaagacacatatcaaaacttttctcccagaaatctatctttaagacttaatgcagtattttataaaagcaccaaaccatttgcaaggctagccattggaatttaacttagaaagaatgtgtgaggttgttatttaaaggctcgacataactctctgagtataaatgtccatgaaactaggattaggagtactttaaaatagaaatcattaaataaatcttaaatcacaaaaggttttccaaacwtaccctgtggtatgtgatcagattgaaactcagtttcacgtgagtcacacacacacagttagggtaaaacgacacactggggatgagagaatggtgggaaacgtgtttagaatgggaaagggcctgctggggaacatgaaccttaaaaggcagactttcycctgctcctggtgttgctgtgtgcatctgcctccatccrcccaggcccaccgagctgatgtgctaagaacagctttgcaattcctgggagctttataccagatccgaatagcacgggcctccctcctcctcaccagatgtttgattctcatccttctcccattcctttttcccctttggtttcagcaggatgggctgagtggacagcaggctgaggccatgtgttactgacagaacaaaggtcactgtgacagcagctcagccctccacttctctctggatggggcaagtgcacatggtggtttctgagcctcattcttactctttccacttgtgctgtacagaagctctgctgcatggttttctcgaacaatttatgctgaactaacccaaagccgtggctcagttcagcccttttatttttttctttcactaaatagatayttttggtggtggtattgaaagttgaagctatggcttgaatattcgtcttcttcaaaactcatgttgaaacttacattccactgtggcagtattgagaggtagggcctttaaaaggtgattggatcatgagagctctgcccctatcaatggattaatgggttatcttgggaatggaactagaggcttgataagaagggaggcctgcctaaaataacatgttagcacactcagccccctcaccatgtgatgtcctgcaccacctcagscctctactgagagtcccaaccagcaggaaggccatcaccagatttcaacccttgaccttagacttctcagcctttagaactataagaaataaattcctttcctttagaaatgactcagtttcagatattctattataaacaacaggaaattgactaatacagatggtaaccctcagttgggattcctgtgtgtcttggtattaggcccagtaatgtaagaagactatggacctcttgaataaacacccctagctctagataaagagtatttcccaattagaatgaggtagatttgtaattcacagatgtttgtcccacttaaccagccaggagctccatctgtcatagatatactggtgagaaaacattgagtatatctataatagatacactctttacagataccctctacaggtatggagttcagggtgaggtgccaaagcctgacagtgggaatgatgcttttccttcgtgtggaacacatcgtttgtttggtttaaccctagtaccagctctaagaaatgtgaatccactgagaaaaatcttgtctgtagaatttatttaaacatctggctgctcagatcagcagagatggtgcttttaaratatttagttccttagctctctggtttaaagcaaagaagttgaaattaatttcagcctagatatgatgagtgttaatcrgaatattaatttagattagrtgctgcatgctttgatcacttctacaatgattctctccctccttttttcttctacttgtcctgcaagactttgattaccttctggggtcatgttagggctctgaaattgactacttttccatattgggaatttaagtattgtcattttttaatttgccctatttttgtcattttcaattgtcccyattttatttctggttctctgcttttaggattctttccaaagcctacaaactaaaaatatgccaaacccatcaggtgcttcccccagtgtattggttatctattgctgtataataaattaccctaaaatgtagcagcttcaagcaatagacatttaatatcagtggtccagrgacctgggaatggctcagctgggtcctgtgctttaggatctctcacaaggccacagtcaaagtgtctggtgggtcagtggtctcatctgaaggcttaactggggaaagatccactcgtggttatgggcaggattcggttctttgaggaccattggattgaaagccttggttccttgctggttgttggctgccttcagtttcttgccacttgggcctctctaacactacagcttactttattaatgccagagaaagtctgctagcaagatggaagtcataatcacaaaaatgacatcccttcaatgttgctttattaattaaaagcaagttactgaaagggtggggattacacaagaccatgaataccactaggtagggactgttgggggccatcttagaggctgcctaccacagccacttaccatgtagttgtcttctaaactttcagattgtggagtagtagagaatgaatggtcattttcctaaagacccatgcataaatcaggctaggctaatcatgaaagtaacttgaagaataaatattgaaatatatgtgtatgtgtgcatawttaaaggcattccatagggtacatgtgtctcagtgaccamagaacagaggctgtattttgtgggtgctatgcattgttaaagcacatgctcttttactcyatcaaactaacaataagggggtgtgggagtttttctccagccatagtttgttaaaaaaacyggctccctggagaggctgcacttggatttgggttctcagtctggtctgagtcactagccaggaggcttttatccaagtagagttaaatcctctgcagcttccctcaatctggagtgatttcaaacttgtgttggtgtgagctggatatttctcagacatgtttgtccttttggattgttgtgacttggccaggtgcaaaagcagattgtcttgagttgggaccttcccaggaggagcaagtgtgagtkgaggaagctgggttacagatggcccattacccagagccatcattactcaggggcctgagggaagatactgacattattctttcttgggtttcctggcgttttttcttttcttatttttttttaatttttatttatttatttatttttttaggcagggtcttactttatcacccaggctggagggcagtggtgtgattacagctcactgcagcctcarccttccaggctcaagtgatcctcacatctcagcccccccaagtagcatgcccagctaattttggtatctcttgtagagatggggtttcatcatgttgcccaggcttgtctcaaactcctgagctcaatcgatctacccccctcagcctcccaaagtgctggkattacaggcgtcagccaccacacccggcctagcttctctcttctttgataacgaaagcatgatctccattatgtgcctggccaggtttcctgttccaagaatgtaggtagatgttgggtatggtatggtaaaatcagtgtggttataggaggagrcaaggatgaagcttgaaaggaagtagtttattacacttacaggtctggagtgggttcaccacatgccayacaggggtacaatcagcagggtgcccaattgaacagattgtgcagtagagagagagtgggacctgtgggttgaatcctttattgggatctgggatgggtttgaggttaattgatgccaagaaatttcactgggctcaaaggcaagtgggcagtggtgaaggggcgggagcctgggggaactcgaggccaggggttaggtttatcatccaacagttcctgctggttttgctcagtacttgggcagtgagaaggatgttgaagcacraaagcatgaactcgaaggatttttaacacattttccaaayaggttctttactagcttaatagagtgtaggattgcactgagattaagctacctctcattacctgagtgataaaggggctctacgacttcttgaacgtttttgtctttatagcagtccctacaggcccctgctagtaatgactaagcataagcagtggcctccttctccttctccaataaagttcctcccttgccagggggctgaaagtctttccatgttttctctcttgacatctgatgtcctgtgcatgcccaggtcccgggactctagtctctatcatggtgtgagaggccctccaaggaggagtcaggactgcgaattcagggagtctcaatctttggggcaggaatttctcacttgtgatatcttcagtctctttggggactttctcctccttgttggtcatttctaatagtttctgtctacccagaactttagtatctttgatgatgccaacagtatctgtggggaggaaggctggtctttcagattgagtcagaattcttaggctgaaggttctaagcacaccgttgatttatttggtagctctggggaatcccctctctcttgagttcaaaagtaacaataagaaactgctccatgggctccagaaataggccctgtgtctcaggaattcctgcttcctgtcattgcttggggttcctgttaccattagaagtacttttagcatgcgtattgtgaatagctttaatttcctgcattcrgctgaatgttaatttttacaggtttagttttacagccagttttacagcctattccaggtccaaggtattggatggtcaccagttttgcccagctgggcatttgaattgtcctgttgaagaggcagagccaagctcagggataattatgacaacattggttgatttcagggtaactgaggagccaatctggtttgtttctacccttgcagatgaattgatatctgctttcttgcctttataggcgaaatgatggtatccagggaggccaaccactcacctgggtggagactctatgggttgcawtgagttcagaatttttgggggaggactcctaggaactgatatatgctgactaaactccccagagacagaagataagcagaatacttaccttctaattataacataagagattcctctctagggaacagaacacctacgcttaatgcccagtgtgtgtacttaatggtattcgagaaagcacattagttattagaggatgacccagtgacagtgtggtctggacaaagggtggtgcaggtaactctagaagaggttccatgtgggtcatgggagcctgggtgaggagctagccctgttcccaacccattcacatcaaatttagggcttcaaatatctgtcttcccatgctgatgtgtctctaccatgggctgcaccgtattgatgcaacacattctcattttctaggtttcacactgatcacaccatcccacattttttttttttctattcacacattttaaagaaacttggttattactatggatggaactactgctttgttttattttcagccaagccttaatcggacctacaccctttgtttatcctccttttactctgaaagacttcctgtctcttaaagtagcttatctcatcccttgggcgttagttttaaccrttcaattctcagagctgctttttttctgctggggatgggaggggtgggtgacttgctattgtcggcatatgcggatttcattaaataaaaggaatgtaagttggcttttgtttgaagtgtcaggattttgttgttttgagaaatatgatggtgaaaattaatcctcatggtgctatgtggagagtgtaggggcctgaattgtttgtactgatatgcctggcaaatttagatttccattttgtaagtattatttcaaaaccctagataatatttttttcttatttcttctaaaagtggaaagtaaagaaaatacctggktaatgggggtgtggttctagatagtaagattctaattagtcaagacagaatgtgcttcttagctgaaaaatatttgggcctcatctggctcctttgcatctacagacgaatgttacagggagatggtgccaacaacgaaagaaaaaaaaaccattgttggatatatttgtctttattgcagcattgctgaaaggaagttaatgacttatagtctaaaggttagttcaaaggtaataacttccttgaattcactgtcaatgaaacatgctgtaagatgtgttgtttttttctgtgagcgactacccatttgatttctacactgaacacgtttagtctagtgtgttaactcacatgttccttgattttttttcttcctttctattaagcttacctttaggtgtcagcatttttctgctcatgctcaaaggtcttctgaagctgacacctcactgggtgttgatccacatatccaaagcccatgcagtcgcacagattgtgtgagtgaagtcatagtgttctttgcttctttcttctgtttctgacctctgcagatgtagatgaatgctcagaaaacagatgtcaccctgcagctacctgytacaatactcctggttccttctcctgccgttgtcaacccggatattatggggatggatttcagtgcatacctggtaagtttcagagggccagattaggcacatgaatctcttagctccttcaaggatatttttctatgacagcccactcttgatttagcctggtctggagccttggtggattttccaagctgtggatttttttccttggttacctcctgctgcctagtttactgatagttcactgattcgtaacatttctggaggcctgcgggagacgacccacccatcgtcctacctcatagcccctctggttaactgccctagtgatctgcttgaccttgatgagtgcaatttggatgaagtgttgagatcaagcttattaagcagagccttatgcgccggtagccagggttaagcccgtggcgaccgtgttagaggagcttggctagcttggtgcagtctcgtgagtggtgagtgccgttggcttgcagcttctcagacttaacctgtgggcctcagggcatgaatgagctttggcttgttttctccagagtctcttgggatgttgggcagatgccaccgctatccctcattttccccagatgacaatagggaggggccgggctgctttacacttagagccagctagggacctataggatgaactagaagaactggagagaaatgaggtaaatagtggcaaggtattataaaataagaatctcgggctccaaaatcccagcgcttttccatgccacgctgtgggctggtgaagtggatgggttgcaatgccttctatttctcttttgtgtcttcctctgccttgatcctggaagactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccrcctcactgtggaccatcaccaggtgagcttaggcctggggctcaagaagcagaatggcactggtggtaggtagatcataattcctgcccagaccacgcaggcasggggccagtcaccatccttcatagcctctttcctcctgagaagacttgaataatagtgcgtacaaatatgcatgtttgtgtcataaggacatagagatatgcaatacatgacacatatgatctgttacacatttgcctcttagacccttgtccagtacaaactgaaagttgagattgtgtatgtaggtcagactgagaacactaccctagacctgttatagagcagcttagggagatctgacagttagaagatctggccagactggcgttttgaccagaaggaaaactgctttcctatgtaactatctcacttacctctgccttctgaatggcaggaaacagtatgaacgctctgttagtatcaataggaaaaattagaaaaataacacctgctagtggagccagttagttttctctaaactgacaatcccagccctctgtaacccagcccaacatctcagaggaggcacagacatctggtttctgttagcccatacaayctgagaacatgcctgctaccatctagagcattccccagctgggtggggcatggtgatcaagtgctcacagtcgattccaacagcaggcagataaggcaactttctgttccttgttgaattattcagggataggtaaaacttgtttctttaatcattacagaagaactttatttaatgaagagcataggattggcttgataccgttttagccaaaatgattccgacacagcttgctatccaaagatccatttttactattgagaagggttccataaatactagtcttggcttttaatgtgtgaaagtaagaagaactggagaattaccaatagtttttttcccttttaatggtgttaactgttgcccgggtatggtggctcatgcctgtaatcccagcactttgggaggccgaggcgggtggatcacgaggtcaagagattgagaccatcctggccaacatagtgaaaccccgtctctactaaaaatacaaaaattagctgggcgtggtggcacgcacctgtagtcccagctcctcgggaggctgaggcaggagaatcacttgaacccaggaggcagaggttgcagtaggccaagatcatgccactgccctccagcctggcaacagagtgagactctgttttttttgtttttttaaaaaaaggtcaggtcttggcggttctcagataggtaaaaattggtaatggtttgatccatagtcgctctttgtttctatttttaggaaaagattttaaaggtccaaaaaaggtacagagaaattctatttccctcatgccttctctttgaaaatgtcttggttctaactccatctgggatttgaagaaatcaaatggttgggaggtgcctttggggaatggttcagaattcgattaaatttattaagacaggcatgtgttaaggacaatgattttaaagggggaaccaagattttaaaggggggggaaccaagagactgagaagtgaatgacgaaaatagrgtcgtgttctcttgtgcggactttttcctgcccacactctctcggcgctggtttggccccaactgctatctctgactggtctcatgtttgatggggtcagcttgagggagggtaaggacgctctgtgcccacaatttcaaaatacttaaacccttgccaaccagaagcacaagagaaagaaattcatggttgggttgaaaagtagcaaatagtaacgaatgaaagggatgcccatgtatgagtgatttgggacacccatttcccaggagttaggcatgtctctttgtttggaatgcagacacatagcacagggtggtcccttaaagcaaaaatggatccttggagttctgaatgtggagcaggggtggaattgggaacttctccaggaaatcctgyagtgtttgaggaagtagcatttccctctctgtgttccttgagacacatttggctgaagaagtcagagtcttaccttctccacggggtcttaaaaagagctttgtctyccatgggtcatgagctacagtgacaacttaacggcattcgcttcccccaattctggtgagtcgtgcagttgagctagagctagttgggtttgagctctgacaacttcattcgcagtcttttgtgttccaagaggaattgtaggtgctggaacctgatcataatgctcccagctttgttctttagagtcactggagggttttgaacggagtgacatgaaatgcctttatgtttaaaatgggccaytctggctgctgctaattgaatttacactggttttggagagagtgagggcatrgaagggtggaagcaggaaaaccagtgggaaggctgttgcagaaattgcagggagaggatgaggctttttgaccagggtgagggggtgcagtagtgagaagtaaagatattctaagtggattctgaagttacccctaaaaagagtttttgacatatcaaatgtggatggtgagagaaaggagggtcaaggataattaggtctgagcagtggaaaaatggaggtgccatttactcatatgggaaagaccaggggagcagctggtttgatggtgaaggcaggggctcagtttctattagtttctgatttctattatacatctaaatggtggtagcaagtagggttattggctatgtgattctgcagaccatgtgctttaagttgcaggaattaaaaaggaaggagaagcacctcctcttgtttaagttcctttgggtagtcctaacataaatgaacaagttatctcaataaccttctgcagcagagtcttctcagaacaacctgtattttggacaaagcctcaatggcactgtggaagcagcctgggaggaaactgctttgcaaccaaagccagcaggacttcaaccatggagtgagctgtgagggaggggacaagaggagaggatgctggagaaagrgggggaaagggcaacacggcaggaagctagagcctgcaggaaaagattcagctttgagataatcccaggcgcagggtggctaaagcaattctggaaactgggctgtggaagaaccatttttaagctgtttgccaccacctctgctatgctttactactaattccactcagttttacctttactccatgtagttttccagtgggtagacagagggcaccgtggcgctgggctttcagtaatactttctaagacacacactggccagtcgcaagatggccctctcctcagcagcttcgagcttgaagcttgaagcaagtggggaatgaatacaaattggctttaagcatcacctcggctactgagtccccaaggatcacctgcacaagtgctctgtcagcagaggcgcccgaggtacaggcaggatgggccttgtgggcctctcctggccagaaggagatcatgccccttcccaggctgagtgagctgcactgctgatcttacctcctcttgttctttcttgatgtggctgggccttgatgacagaccctcctggcaagaaagaagcatcacatgatctatttctgattcccatggtggagaagtacttagaacacatttgcttcccaagtttggtgtccacgggcttggctgagacctggacagtaggagaaggaaggccaggaggccaggcatggggtcttgagctacattttgcattctgtccttgactcacaatcaaaggtttttcttcttccctcttccccatctgctcagagcccacccagaggcccccgaccatctgtgagcgctggagrgaaaacctgctggagcactacggtggcaccccccgngatgaccagtacgtgccmcagtgcgatgacctgggccacttcatccccctgcagtgccacggaaagagcgacttctgctggtgtgtggacaaagatggcagagaggtgcagggcacccgctcccagccaggcaccacccctgcgtgtaagcacctggccgcccccgctcccctcagctgtatctaaggcctttgctagggatggtgcctgctgtggtgaagtggggggacatgtggggtcaccaggtctaatgaaagaagtcactatgtgctatgttgatttataatctggtccacacaagatcccaatttgcgtttggtgtctggtttttgtcattagcagcttccataattggaacatctgcaactcggttcagcaggcagttactccccctccccagcccagggtgacaggggacacgtgtcactctggagtcctaaaaggaagctgacacaatgctggctctgttttttttttctcttgaaaaaaaaatctgttctgctttgttctgagggaagtgttttgctgtcttcttccctagtaaatggcagatttacataattgatccttaaaaaaaccctagaaattagaatttcttttgaagaacatctggagcacatctgcgtagggcgaagaacttttgatatttttggaggctctggtatgtggtaaagtaacttttcttcccatctccctgcctgcccttgttccccttcctgctctcccaccctctctcccacaggtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagyggatttctcctgtagggggcagggctgygtggytttcccagtgggagccacctcacaggccctgttgcagtgaggtggactggtgcagggaagtcctggagggtttctgagctgcagcccatyggcatgggcccgatgccaccaccataggaccagggctctctcttgctgggagtcacctgtcactgaccaaggctgtgctctctggttcgttcatggagtttcagataatatggaaagggaacyttagagttgtcagcacatggaggctgtatggtgatccaagggaaaatggaccgactcttaccctaagtccccagggttgtatgtcataacatctccatggaaatcctggaaatcaaagtgacaggacaacyagtcacaaggtgtgatctctgcgrtttgttggggactccaagtggaagtcagttaatgactgtctcaccgttgcagcccttccctttcactttggttctgtccctttgacccacttctttcctaaccttccctgactccatagatgaaaacttgaggagtgtgtgatgctgggagaggagtggatggagccttccccaggggatgtttgatgcttcctgagccagcagcctccctaatgcaaggcaccccattttggggagcgggttttctcaaaaatggaggaaaaaaaagggtggctgtctcgaatggcatcgacacagtggaaaatcatctgattccattgttgaacttcacactccaggcacttgctcatccctragaaagaatagtacggcattcaagtttacatttacttctgttaatgaacgacacttatttggttccagaaaagcttagaggcagccagtgtttaggaagagatgtgttctttttaagattcgagtttgttgggtcctgtcccctcccccaagaaaactctcacattgttttgtaaaactttctctggaagaggtagagactaagaagttgacatcactttaagctaaccctcttttattcaagtcatagagcttgattgcctttctgaacatgcccctgaccaggacagggtggtgatggtagtggtagtggaactgaaagaaatgggacgtgggttatttgcacattttaaggaaatttacttaaactgggactttttctctaacctgaggttatgacatgggtttatgaatcccatgattcccgggttaatggaagctcatttgaatgtgtactcttgcctgggacaaacgacttttcaattttcaaataaaagtgtagttgaccttaggcccgccccccatataagctgcctgtttttccactgaagccaaatcccgttttgtacaatctttcttggctgactacgctcccagggggcgtaagtgaagccaagccccaggaggctgttaggcaaggcaggaacttgtatgacctcagggacagccagctaacccctgaatgttggctttgcacatctgctgggcttctcagagcaggagcctggattggaaactgaatgaagcaagttctgcatggagttgaggaaaaatatcagactcagcattttttttatttttattatttttttaaaagacttgtcatttatttagcaatgaggaggagagacctcactagccagaggttggataaccactactccctagttccttaacccaataaattagattttttccttcttttgagacagggtgtagctctgtgttgcccaggctgcagtgcagtggcaccatctcggcttggtgcagccttgacttcctgggctcaagcgatcctcccaactcggtctcctgagtagctgggactacaggtgcgtgccaccatgcccagttcatttattttttgttttttagacggggtctcactatgttgctcagtctcgaactcctgggctcaagcaatcctcctgctttggcctcccaacggacagggattacaggcgtgagtcactgtgcctgactacactttctttagtacaggatataaccaacatcttgcctcctaagagtcaggggcaggagtataggtgattgtacttcaggtagaggaaagatctcattcacagaggaggggagagtagattttgttggcatatagtggcaaattttattaaggctctgggaaaagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatrtgaggcaggtacactattggcctcattttgcaaatgagacaaacgcatagaggttaaatgcccaaagccacatggctactaagtggctgagcctagatttcacccgagtgcccacatgtccagctactctgctctgttgcctgcaggatcacagtgcagtgttgctcactgcagctgtgcatgagcaaggcagctgagtgtgaacaaaggggaaatgtaacctaattcttctaattctatgatttgatgcacaaagggctccataatcgtgggaattgattacgactgccgggagaggatggtgtactggacagatgttgctggacggacaatcagccgtgcyggtctggaactgggagcagagcctgagacgatcgtgaattcaggtcagcagcttcactcagcagtctgcatttcatttgattctacaaagtcacttgtctactttacgccgaagtctcccctcgatttttctccattaggggaggttaagttctaggcaagtcattttattgagctgtataagactagccccctctgtaagcaaacaccttcatacatacggaatgaaataggtgattcctactgtgcgcacttcttaaaagaattcatggtaagaattcagggtgacgccttcgtttattcagcctggctctggcactgtggatgccggttgtcatcaaactggtaggtctgctggtctagaagctagaggtagtggaatatgtaacaaaagtacttgtttctctattaacctggttcttggggacttggagacacttgggctttgytttcscctgctgacccccctgcccacccgacygttggagggcttcaggtttgccctccatatcctgcaaacactccagtcctgamtttgctttatttccaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgagggtcagctgggcttccctaattcttctcttacctgtagatcctgatgtgaagcccttgggttttaaatacaatgtggggaaggtcagaacaagagagtgaaagctcaaatgcattcakgtaacaaagatttactgaggatctaagaggtgtcaggacctgttctaggaaaagacaaggtctgttctttcatggcacttatattttattaggaggaaacaagactggtataaacaatattagtctgtgatgtgatatgtagaaaattcagatagtgttgtgagaactagggctrctctgaatcaaatgatcaggcgaggcctcagctgacacttaaactggaagtgaagtgggattcctccagcagcacatttagaaaccagggttgacrctcacagtagggctgacctacatcaagtgacattagccaaagctcagacacctctggcttcagtgttgctgtagcagaaatcaagataaacattttccctgtctgtataattgctaaggtcatcaaatgtgacatacaggatttgtycactgtctcagtacttgttacaatcagggagaatttttatatcttgagaaactcttgccatgtttaagtggagtttctacgaaatgaaattcccagatgcccttcaaatcagtaaagaaaaccttcagctttaattttcaggtaagtgctttttgactatgaaatacttagtgcagtgcctcaaaggtggtttcaaactttgggttctacacacaggaaaagtacctgtatccttctctattccagttgacttaacaggaattaatagccctcttaaaaactctttgcataggcttgcctttctgacatttggacatttggaaggtccttttttcttttttttttcttttttttgagacaaggtcttgctttgttgccgaggctggggtgcagtggcacagtctcggctgactacaacctccatctcccgggttcaagcaattctcctgcctcagcctcccaagtagctgggactacaggcatgtgccaccatgcccagctaatttttgtatttttagtcgagacagggtttcgccattttggtctccaactcctgaccctgggtgatccacctgccttggcctcccaaagtgctgggattataggtatgagycactgcgcccggccccttattccttcttggtgcttgacctgaaaactggggagagctgccatcttgtaggcaatgaaactttggccatgtctctggagtctggggaaaaagcatacttttaagctgaaatccacatcacagccatgagtttaaatatgaaagtagaactttcttatccagacagcaaatataaatgctaaaggacttgaatttttaataaaaagaaaacccaccttgaaccaggttgcaatataacacatgtaattacatctccttcaactgcgtaacagaatggttgtcaagccttcctgcatatttctcatttgctttctatagatttcacctttacaactttcttcctctggcaatccccaaataatttacaccaaatatctgtgtgagcttgtttcagacttattgttgttgatgatattaaatcattttggggaggagactgatcagaagcgatgaagcaatgatatgcatgctgtaccctctggccacctccaccttagcgcaaagtggaaactgctttctagcttttgctctcagcttctctctgcttcatctgttgggcataagggatgaaattcgcaacaggggaaacctatggtttcttcctctcctctcactgaggttctctgtagcccaactgatttattcaaagcttctatagcttttataaaatagtattttataaaaagtgctttcaacattatttctgctctaacgataaacctgtttgtttccttataacctatttccacttaataggaccatatttcctcgttagtatctgttatgaatatatttcatttttaacgtggcatttaaaaggtaaagtgcttaacttaaaatgtttccatccctgggtgccaggtaccccttcaagtaccaaattgtatttttggcagaagaaagaacagtttccttctcaaatccctggtccacatctcttcaagttccatagtttgtatcgaagccattcctaacagctgtatttgtttctattctaaaacccaagatccaattcaagacttcaacaaacggagggttttggggcagttgagtcaaggggtatcttggaggcagggattctgatagtaacttagtaatgacttctcccacatagtgacaataatcagaaaaccttgtgatacaggtaaaagtggaatatggctgtgtattagttacctactgctgtgtaagaaattgcccaaaccctcagcagtgtaagataacatttagtctcacagtttctgtgagtcaggaatccaagtgtgtcttcaccgagctccctcaggcatggagtctctcacaaggctgcaatcaggtaatggccaaactgcagtgatcacaaggctcagctcggggaagacacagcccaagcatgctcacatgggctacaggcaagactaatgtctctggccaacagccctcaaggacatcagttccttggcacatgttcccctttacagggtagcttgcaacatggcatccagcttccctcaaagggagcaagagagagcccctaaggcagaaaccagttttttgagaccgaatatcggcagtgatagcctatcacttctgctatactctatgcactagmagaagcaagacactactaatgcagcccaaactcaaggggattgcttaaggctataatacatgaggagatggagatcactgggggctgcttagatgctgcctaccacaggctacatrgctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggtaatactactgatggaatgcaaatagataacctctcatcacagtgaatgtgagcactaacagattttactacaaaatgaaatcccatmacttagatctcctttctttggtctgtaaacttttaagtactagtaaatttaagtactagtaaatgagtcttaaaatgaactttctggggtttgggtggagggaaggatatatcaagcagtaagtttgtactgcttgcctgaccatgagtgcctggcatatttttaacagttaaaagaattagccattgttgaattgacaaacttaagtgaagttattcttatgyggggagagggtcactataacttacctataaacatctgttataatgctaaggacattctttggaaagcattgtagcagggtagcttccttcagtaataacatgggtattagcaacctacatttgtttgcttttatcagcacaactgaaaaaatgctgtgtgtctagttctatactaaagaatatgaaaaagactgttcttgaatttgtaatctaataaaagggcctaatgtacataggtcacttttataacccagttgtttaaaacaagttacatttcttaaaaggatttgaaatttaaatcggctccatgagaaatgtgaaacttggaaattcttgaatggtttagctattgtaaaaatttttaagactgattcctttacattgaaatatragttatgttaccattttagtcacttttttcctcctacctagaaaatattttaaaaatactaaggattttggttaaaaggttgcctcagtaattayagacatagcttacaaagggcaagtatttacccagatgttataatttataagctaaggcttgaaatcacacaaattataaaaataattatgtttaatgccctactttggcagaaacttaccagatttcagtaaatgcaatcctgtcttccaaaaaaggattgaaagtttgaatctctactaaaaactggagactagtaataggacaggtaattttacagttgctaatctatgactgtaatggaagtaaaatatcctatttccccattctatcactgtgtcactatcactatgtcacyatcatttttggcaaagcagctgaaggacctcattttccccctttgttttaaaaggaaccaaaaaactggagtgtacactacctgatggaactggacggcgtgtcattcaaaacaacctcaagtaccccttcagcatcgtaagctatgcagatcacttctaccacacagactggaggaggtgagccccacaaattctggacaagcctgaaaaggccaactgttccagaggacacaccacttgttttamcaaaagtcagtacctgacttgactcattaagccctctgaggcttttgtttcatcacctcctcattggcagataagatccttcaaggatgtttttcatcctttcatgtttttgaaatcatccttttacttcacccagaaatcgaatggtattgctcacatatagcttaaaaagtagcaaagctattggataatgtctcaaaagggagcatattaatctaaatatgttctttagagaataagactacccttgataccatgagctatattacagggcttaagttggcttttgacactgtggacatattgtctgagggaccgaaaaatactatttagactagttctcaaatgaggaactgtggaacattaaagtctaagccctttacaccatgccctacaactctgatttgatagctcatcatgtgattctaacatgcagctagagatgagcaatggatttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtttactgatgagtatctcccagaacaacgatctcacctctacgggataactgcagtctacccctactgcccaacaggtaaaaagtatgctttaggatgctcctttaaattagcagggtagagaagggatatatatggtatttgattacccctgctgcctgtgacactgccaccattgccttcttcctgccctgagggccagtctttactaccttaaatctacctagtttatacacaaaatgcaaagacttgctgttgcaacttggttacaatatactcacccaccaccctgtcccacccctgctcttctctcacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacwtcttgtwaacatttatcattaatatttaaaagatcaaattcattcaactaagaattagagtttaagactctaaacctgatttttgccatggattccttctggccaagaaattwaagcacatgtgatcaatataacawtataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatyctgtagtgcctctatagaagtacccacagaaagtaaagtatcacatttataaataccaaagatgtaacaattttaaaattttctagattactccaataaagtgttttaagttttcctatgacttaaggatctatattgtctctaggacaaagctgggggttggcatatatgccttaaccacaaaggagaaaggtgatttatgcaaacatacagtacataataaaaattctactttcctaaactttattaaaraaaaaagcaataagcaatggtggtaaatctctagaacatacccaattttctgggcttcctcccccgagaatgtgacattttgatttccaaacatgccagaagtgtatggttcccaactgtactaagtaggtgagaagctgaagtcctcaagtgttcatcttccaacttttcccagtctgtggtctgtctttggatcagcaataattgcctgaacagctactatggcttcgttgatttttgtctgtagctctctgagctcctctatgtgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtctaaagcaacaggtaagccctttaaaaaaagaaagacaaaaygagagtatttatggttaagaatagcatcctttcctcaactgaaactgaaaagcacctagctattctggtgtcttaactcttttagctgcatgggcaagggaactaggaattttgtttatatttgctttgtgatgattgtgattagcgagttttccctatttcaaccggttagggggaaaagttaacctttaaatgtaccaggaagctctatagctcatccaatcctttagcccaggcatacaaaacaatatatccttattgcagcagtgccttgtcattactgctatggaaggcaagttgagccaggctgttactgtcttattttggcgacagtaagcaacagtataaacggcaaaaatagtaccttatattccatttctgagcacattaatttgtctttacaaattgtacgaacctttcagccagcatggtgtttgccaagattatgtataattatgtataatttaactttcaagacttgacttggaagttactttgaaacaaacagtctaggaaaatgaaaaactaaaccactcagcacctatggacatactaaagatggtgactatggtgatgccaaacttcacagaaacaaattctaaaatgaggacagtctgtacttcctgctgattatataaaatcactgccaagaaaaacacastacccgtactttcaatctttcaatgttacaacctgttactattcaaatgctttagtcactgctcaattcttgccttatctagtaatgtaaatctacgtaggctctgtctgctttaaaacagctaacacatgtaagtctgaagaaaccaatgggtacgaaagcacaagtgagcaaaattaaagagcagaattgtactgagtggctttatatrttcatctagtaccagaggctccacttttttttcctttgccaacaggccaccaagctacccctgaaaactaccatatgcctcaaatagtagttataaatgcttataagtacactagactgtaagaactccactaaattgttataggctggtatcttttgagatgacaccaaaattaaaattkggagcattaaaaataaaactaaattttactttacaaacaagagcaaagagatttggctaagccttwacttacactgccttccaaagcatagttttgctgaaggaatgaatgwatgaatgawtgactttattacaccagaacaatttactgtctgttctatagkgwgggtgaaataagctgatctttaayccaacttccagtggctcgattcatatacaacgagccagtaagaacctttaaaagaaaacagtgtctttcagagatactgccctggcattagtaaccttttaacactgcttggcctgcctaaaggggctggaggacaaaaggcattgggagatgggggaagggcgcagggaggacaaacaacatagttgtgcccaaggcattcactacaacatcattgctgcaggaggcaggtgttatcagacactgctgctgctgacctgaggacagtctctccaccgctgcacagccagtgaaactttaggcatctttggatttctgatataatctaaaaatgttccatattttctctttaaggggaaggtagtcatgggatatagcttttctcagcctacaaggtaggactgaaagataccatttcagtcacctgtaccttgaaccttacactccaacagaaccccctgtcccttcacctgggcagactgacaagctcatgcagacatccacgcatggacccttctccccacctaccgtaagagcacaggctctcaagtcagactgcctgagctcagtcacttaccaactaggtgaccttagccaaattactttctcatgttttatgccaggaaattgaataaaacaagaatttactctgaagaaataagagcaaggatagaatttagatagaaaaagaaaactaatttgtagtgaggtgtgttccttcttctccagcatgagtcaaaataatccagtaagtttcatatgggtaactcattttaaataaacttcaacgggccacaagcatgatttgtggactgtgcatgagctatttgtggcttttttaaggtacaaagtgagaggaacatgaagtttttcactcaaaaatgmccccctagccactgaatacattcaatttgctttaggaagcactgaagtaagctatcctttctctaagttgtagaacgtagaatggatatcttaaacagatayatgcaaagtttaaaatcayggccataccagaagaaatgttcattaacaacttatttaggatttatagaaacgtacctcttttgtttgatttgccttagcaactgcatcctgtgtcaggcgctcctgaaccaaaatccgaattgcctaagaaacccaaaaatatttttactttttataggctgtgtacctgtcatcctttcttctatgagcccagagaataaggatgctcattttgatgaagtcagaattacctaagttcattaataaactccccattaaattaaaaataaaaaaaacccactaatataacgtaacctttcacacttctagtattttaataatgttgaatggtgcttgcaacaattaaaaccattttttgaataggtaatgcacgtgactggtaaaaaacaactttaaatacagcaagacacatggtaaaaagtaggtctccttcctacctgagccttgcgatcccctacagattccttaccctcactaaaactgcgaaatgacgagcatgcttagcacgaatacacatttttgacacaaagggtagcagatcatacatactgtcttacactttgcttttatcacttcactctagtaaaatattttcaaacctttcaaaggacaccgttggtggttttaatcaccaaggcatttcattatggtaggcatgcatgcaagtatccatacacacttaaaaatcaaattttaaaaaaatggaattttaattaggaagatgacaattacaactcaaaaataagtgtgaaaacttaaactataatttttaaataaaaaaccaaatgctatctttgaaaaaccgaattcaaacaatgtttaacagttattgcagatgttattaaatagtctggttgccaaacagttaatatactgatgcttgtacttggcaaacgtactaagatgttttccatattatgytattgtttgaatgcctcttaaaataactcaaaagggacaaatgtgcagcaggactagaattttatagcattttgttgtagttgatttatactttatccccttgggttttgaagtctaacaaaagcatcccaaatacgctatgcattgtctgactctcctctcacttactttatgattaaagctgacatgatcactatagaacagttccaaggcaatttacataattgtcggaataaagaacaagcctttgaaatagctaaatttcactaaaaacatttttgtcttttggcatgyaatctggattgagaaaatccaagttaacattcagattcagtatagaaaattttaataacttaggaatacaacagtcttgttaaaactgacatttaataataaaaatctaaaaagcatggtaagttatggcttaatctcttctgggtagagtgatatttatcacaaagtagtttacatgcacaaggtctagttaaaagcttttaatctcttataaaatttccaagtctggtatcttaagtaccactcccctgatccacaccactgtactttcacgattactaggaataaatcttctgaagtttatgatttctctcagaaacaagagacctctttcagattactgggattcctgaagtatagttatgaactgagtggcctatctagcatcggggacagaaagattcatttctcaaagagattttggggttatatatttttgaccaaattcaccattactcatttggcattttcgaccatcttaacaaatgcagactatgaatcattaaaaagactmactaaacagaagtagggtaatgtgggaaaaacaatggaccacagggttatagtgcttaaaatcctggctytgtcattttctgtgtcatcttagacattatcctcattgagtctcagtttcttcatatgatatatatttttaaaaagatattagcagctgtctctaggattgttggcaggattgaatgagaacatctttgcaaaggatttagcatagtgcaggcagaaaacagaatccaaatcagataaaaccatgaaatctactttatgtttcatattcttctgtgtattttagtcattcaaccataattttaatatcaayagttaatatttagaaaataaagacatttttctatgtgcacagtttctgtcaagaatcaagaacatgaagctgaccttaagcattaccaggtaatcatcatgacgctgaatctgaagcaggttagccaaagccatcacaccagccttaaaatcaggattatttactataaaagattaaaaacaaacaaaaacttacaaccctgcaaacgtataattacaaacatatttgtgaacatacaaawacatttttaacttttcggtagcaacaaatctcktagtttttaaaactgctactcacaagagaaaaaagaaagccctgtagactatcaacaattaaataaattggtaagataaaatggttttcctattactgtatgagacggtccccaayttaggatggttagacttgtaattttttgaccttacaatgagttcagtgggatgtaaccctagtgcaagatgaggaaaatctgaacttacagtggttccaactacaatttttcagctttacaatgggtcttccggggtattaaatgcatttttgacttatgatattttcgactttgggacatgatctcatcctaagtcaaggagtatctgtatttcatcagccaaactgaataatccaataaatgactaatttaactcacattatatttgtcctgtaactttttctgcaaggctaaattatacagcacttttaattaacatttcttcccaaggccattaattttagtacatagatcccctccatggatagttttcccaaaaccttctctctaagcagcagctctggagtgtccaagaggctcactcattcaaaagggttaactcctaaattataggtcacaatgaattagccagtgaacaaatattttacacatcataatttaggtaattagattcttcatatttttaaaaagggaaattactaaaagatatccaggacttaaaataatggaaaattttaccacttgtctgatagagtcattggattaaaagaaatttacacattcaaaaaggcaaacaatgacccccatgattaaatacaaatcaaaactccaaat

SEQ ID NO: 13289 - DNA, 96539 bp, Homo sapiens
ttgtttttttattcttttttcttttgtctcttctgactgtgtattttcaaatagcctgtcttcaagctctctaattctttcttctgctcgatcaattctgctattaagatactctgatgcattcttcatcagctgtgtagcctggggttggtgaggcgggacaaagagggagaggtgcaagcactcttagcttccccagctggtatcttaataggtcacacgtcccaccctccaactcaatctactggctttgagcccagctcaataccaggacttgcataagaattgcagttcttgtggcctaaactgcccctcaagttcacttagggccccagtgcctccagcccacagtggcaagccttgccagaactcaagctccaattgctggaatgggcaattaccctctgccttgggccggtccaaatgccccctccatgggcaggcatcagctgagtacagctcagtttgctttctgctgtgatggggcagcactgagtctaatgcaaagcctcatgaccgctgtgctccccctctctgaagcacagagattctctccaacagggagctgctgctggggaatgggggaggagacagggatggcatcagcaatttaagactgtctttcctaccctctttggtgcctctttcagtcatgtgaaatcaaagccaggcactgagagtgctcccttgatttttggttcctatgaagattactccctttgtgtagacagttgtcaagctaggtgttcctgagaaggaatgattggcagagccttctattcggctatctcactccgcccctcccctggaatcactttttaaaatgtttgtcagttgcacgttacattgcttgaataagatttgtaggtaatattgccttagcatggctgctttcctcacagggatggagcttaaaactttcctaaagccccctctagtgacaaacagcaaattattatccattatttcatacctccaagctctaaatacctccaagctctaaagttccattttctcatttagttattagatgaatcaattgctacattatttcaattagagaatgactgagaaatagttaatagctcaaattctcaagcattcttaaatcactgaaacctaagcaattttgttttgagactgaggtcagcacagtgcacatttaactctataattttactctgccctcatacatataatttttaaggattccctaaatttccttcatttttgtctttcaggaactttaagggttaaaatatgttcgcaataactcaataaatagaaaaatgttgttttgaactttggcttcttgttgttttcactgtatttactggaacattttctaaacacacaaatataaattccaggaatcctctgaattatgaaactaagggtcatccataaagacatagattaaatatataataataacataatgcttaaaataataatatataataaaacagaataaacaataaactatatattatttgcataactataggttatggtattaaaatatatagtttatttcacttatataaaattgaaatatattgtatatttcaaatatataaaagcccatttccaaagggcttagagctcatccaataagacaggcctaattaaaccattaaaagaagaagtcatattcctaataaagggaattaacgagataaatttttaaaaggctatgaatatttatttcaactgagcacaaatcttagttttgaggttcctgtaagctaatacaaaaaaagaaacccagtaattgattagttcatgccaattcattaagggaaacaaagtatttccgtctaaaacacacatatgggtcaggcacagtggctcatgcctgtaatcccagaactttaggaggctatggcaggtggatcactttaggcctggagtttcagaccagcctggccaacatggcaaaaccctgtctctactaaaaatacaaaaattagccaggcatggtggctcacgcctgtaatccagcactttgggaggctgaggcgggtggattgcctgagctcaggagttcaagaccagcctgagcaacacagcgaaaccccgtctctactaaaatacaaaagaaattagctgggtgtggtggcatgcacctgtagtcccaattactcggcaggctgargcaggaggattgcttgaatccgggaggcggaggttgcagtgagtcaagatcacaccaccgcactccgcctgagcgatggagcgagatttcgtctctacaaaaataaataaataaataaacaaacaaaaacacatatgcagatttctaaatgtcaataacaagattatagcattggaataatttcagaacatgaaattcaggtgtaaacatatatattcaacaaaaggtcttcagaatgcctactctccaaggccattgcagctggtgatgattttcccaatagaagggtgtttcttgggagctcaccctataataaactcataccagctgtatccatcacccatgatcatgaattatttcctgggaatagcaaccagaaagaatcttctctcttgtttacatacatagagccaaagcaaaggacaaattaaattgcacttaggataacatgttcattgctaaaatttgagagacatagaccctattatgcacacattcttgaaataattggaacaaaatattgaaagggaaataatgaaatagatggcttcagacaaagttgggtaccagacaatatggtctccagaagtttctcccattctgctgccctctccagatcacgcacccccccgttctacttgaaaacmaaatctacttgtcatcctaaagtctacttttctaagaggagctggtatcaccttccctgagtcaagtcactgtgttgcttatcccaagggtgtttgccttgggttccttgtttctaattcaatttaacaaatgcttactggaggcctattatatgcaaagtatttgctagctgccagtagtgaaataaaggccttcatgatcttagaaatggatttcaggcaataatgagtacctaggaaggagtttttgttctctgcatgatatgatttggctctgtgtccccctccaaatttcatgttgaactgtaatccccatgttgggggaggtacctagtgagaggtaattggatcatgggggtggattttccccttgtcgttctcatgatagtgagttctcatgagatatgtttgttaaaacatgtgtagcactttcctcttcgctctctctccctcctactctgccatgtgaagaagctacttgcttcccctttgcccttccaccatgatagtgtttcctgaggcctccccagccatgctttctgtacagcctatggaactgtgagtcaattaaacctcttttcttcataaattacccagtctcaggtagttctttacagtaatgtgagaatgaactaatagactgcataacatctgactccctgcccctgtatccttccaaattacttttgttgttggggccacagagccatcacacacacttcaacatgcctccaattttgaatcattgtctgcctaccctgggttttaggaaaacaggggttcaagcgttattataaccgggtttctgatttatttctccttccttgttacagagtttctgacttactccctcaagcctgaattccctgatacccagctctgctgagataggaatctcagaagagagaaagctaacatttattgaatacattcttttatttgccaggcactgttaattcttttaactataaaattagtagcatcattttttcatcccaagcaacagagaggtagactgttgatgaaaagagtcaaactctgtaaaatatttttagagatttattctgagccaaatatgagtgaccctcaggaggtcctgagaacatgtgcccaaagtggttgaggtgcagcttggttttatacattttagggaggcatgagacatcaatcaaataagaaatacattggtttggttcagaaaggtgggacaactcaatgagtatgtaaatttaaacatttcctggttgacaattggttgagtttatctgaaggcctgggatcaataaaaaggaaatgttggggttaagataaaagattgtggagaccaagtttattgtgcagaggaagctctcagtatagcagacctcagagagagagcagattgtaaaatttgtcttgtcggacctaaaagggtgcctggctcttagttggttatctcctggatttggaaaggaaagaaggaaaacaaaggggaaaagagattctctatagaatgtggttttttcccacaagagattttgcagggcaatttcaagatatggcaaggaaatatatcttggggttaaatattttgatttttttttccttgtctcataatattatgccagaatcagattggaaagtaagtcatggtatatagagtcaaataaaacccatctgataagaatttatggtttctagggcatgactccctagacaccttagataggaatttgggcaagataaaaaaattagagcttagtcctcaactctacagaagaaaatgacatttacccaggaatgggcattgcaataggaatatgcgtgccatggcaaactgtttgcatattcaaggaattaaaggaaaaaaaagtttttttaaaaaataaaaaaaggagaggattacataattgttttgaggtaattagccttggctccaagcatcaataacaagggtgatgtcagttcaaggttggacagacaattgctggacagatgtcctcatagaagtatctttttgggtaaggtggaggtctttgtgcaaggttgtggttttcgcagtattttgtgatagttttattatcaggcattcatggatgagaactctccttcatggccttctccagttccacttgtcaggttttctaacacatgtgactctatttttgattctgacaactttcacaatctacattagaaaagagaaaactggggctcagaaagttttagaaactaattcaagatcaagctggtaagtagcaaaaaatttagaattaagttctacatatctggttccaaaaccaggactcttttcattacagcagtggttctcaacagagttgcgattttgccccccagggaatatttcacaatgtctggagacatttatgactgtcaggattggaggtggagtgggtggggtctgcttctgagaagctacttgcttctagtraacggaggacagggatgctacaaaacagttcatagggacagcacccccacaacagagaattatacaaccagcccaaaatgtcaatggacatttgggctgagaagtcttacatgacagaatgcttcctaccctgatctgacgttatttccaaggattcaaaggtaactgcttcaaaattaaacaaattatagaaagccatcaataaatcaaccccttattcatgttgcagctctcttccattataaataaaaatggattgaaacttacgataaaagggaggcagggacaggagcggggaagcttggcgagcagaaaggaaattcaaacttattattaaggttaagaattaagatgtaaatatgtagatgtttttcacccctaggattttcactaatccaaaagttcacggactgctttgaaatttaattatttggaactggttaaatgttaccctgacctcagctaacatttgtgtttcacttttctccgggaccsaggggacgtggatgccagatgagtccacctcctctccctgctcttcccgcagggacagagcctgccaggtgctggtgactcggatcctgacaggaggtcgctctgcggaagactggcaggatcccagagcaacagactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcracggtttccctgctgctgcagcccccgtcggctcctyttttccagtcctccactgccggggctgggcccggccgcgggaaggaccgaaggggatacagcgtgtccctgcgrcggctgcaagaggactaagcatgratggcagccggagaggtaaagggcagctgtcaggggctaccgccgcctcgcccctcgctccaggcggcgctcccagcctcgggtccgggcagctgagtgcaaggccgccccttgggcgcttcctacccctggctgagtcgccagtgttgcctggagctgcccaggcctgcgcaaaggaagagggagagcctgcttgccagcctcgcaggtccgcttctttgccctgaatttgtcgccctgacaccaggggcccctgtctcctgaactcagggtcgtgcagcctttaaaacctcagtagctcccaggcagaggaaccaggtttggtctttggagtcagacctccccgggccccaaatcaaacccctctgctctccatggagacgaccctcagttttcttatctcttgaacgtgagggtcaaatacccaggccatggagttcttgaggattaaatgcagataatatagagaagatcctggcgcatttgaagtggtcagtaaatacgaaatctcccagtaacgaactacctcccccaaagctactgagtaacccagggtttctgtaactttctgtgaataggaatcccctcagggtcatgttaaaatgcagattatgattcagtaggtcccttgggggtggctgagattttgcatttataataaattccaagtaatgcggtgttgctggtcagcggactgcagttttagcagcaatccgtactcaccatatacacctgttctctactgatttcttgagtcaggtggacatcatgtggtggggttgggggtggggaaatacaatcttaaatatctacaaatcggcccaaaccaaataatttgcattttcacactttctgagccagtatcattctttcctcgagtcaaatgaggcaatctttatagactccccgcccctcccaattcagtgtttttatctatttaaaagactgcctttaaaccaagctgctagatgattccttgatgtctttctttgaatgagtctgcctttattatatagtcattgatcaaaataagtgctactccgaatgtaggagataactattcattgatcagcaaactattctgacacttcaccaacctaggtttcagaaaaagcaaatcaaaacgctttatgatcttaagaaattttgcatataaactaacattaaacccttgctatgtactaggaactatttccaaattatctcatttaatgtacaaaaataycttgataggcattagccttatttcatagtgaagaaactaaagcaaaagatcacaaataacttgccaagatcacagcggcagaacaggatttgaatctaggtgaagaatataaatctgaagccaatgcatttacttactatcccatggtagggatgggcagggggaaaggataaatgtaacatttagagtatggtagatttagtaagttgtcagtatttgtttattgaattattttaaaaattgggttcatgccaaatgtaaaaaggtttatatttttacaacttgcacaatttaattagcttcatttttaggaaataatatatgataatgtcaaatactgttattttgaatttttaaaataaatgtaatcaccaaataaccagggcagtcagctttcatgtactgtaaattaataggaaaccataaataattttagacacagctaaaataattgagaataaatttcttagatttcattaggaggtgcttttagttatttcagagcataaaatattaaaacatctaaagaaaaattatcttttgtcatgctcttactgtaatcacgttttagacattcttttgtaaggcaagccttctaaatggtggtatagtacagcaccagactgaaaaacsgttagtcttgtttgtaatctttgtttcctactaactaactaggtaatcttcagcatgtcactgtacgtccctgggcctcagttatttataaaatgggggcttggactaggtatatataaggcatggtttccagcttcctatgggggaaggtgaagaaaagattgagaataacaaactgccattcactctaatatcaatgacctttaggaaggagaggagacaacctattagtatattactgaaagtaacttgaaaaaaaattttttcccagcactctgggaggctgaggcaggtggatcacttgaggtcaggagtttgagaccagcctgggcaacagaattaaaccctgtctccaccaaaaaatacaaaaattagccaggcatggtggcgtgcgcctgtagtcccagctactcgggaggctaaggcaggagaatcacttgaacctgggagggggaggttgcagtgagccaagatcatgccactgccctccagcctgggcaacagagcaagactccatctcaaaaaaaaaattgttttgatctgttggtctcatagagacacttatcaatggtagatttccaaacctttggttttccagagaaaccttgccacaagaaacactttcatctttcctcactggactttcttctggctattttaatcaaattgtgtaggaaaatgggctgctctcatataccagtgaatttcaccactaagaccttcaatctcattgacaagattttagtcctaatagttagagaatgatgttcttttccttggcatttggtttgaggctacttctccatgcccctttggctcattctgggtccagtccagtcaggagatagaaaccatacagtgatttttatacaaggaaaagttaaagaattgttatactttcataaaagagtaactataagatgtaaggggctgggcgtgtcagctcatgcctgtaatctcagcattttaggaggctgaggcaggagcatcacttgaggtcagtggtttgtaatcagcctgggtaacatagcaagaccctgtctctagtatataaaacaaattaatgaattaattaaaaagataagaaaactgtatttggtacctagaattacgggaaagtactcaaagaaggacaatttgaaagagagtttctcccaaagactggggttcagacctcattagagaaggcgtgattgtgcacttgcccaaagcttcatcaccgaggagtgatatcggaggcttcacattccatgggaaatagactttgataaattgcttagccaagtcactaaacaaacaagtgaacaacaatgaaaacaagctcaggagaggattctgtatctagagttgctgcaatatattacctaaaatgttaacttttcaacaaaaagaaattgcaagtcatgcaaaaaaacaaaaacaaaaaaacaggaaaatgtgacctatacacaggacacaaaggaggaaccagaaactatgagagggtagatgaattaaatcgtcttatttctcccctcaattctgttaggtttttttttttcctttctctttcttttttcttttttcgagacagggtcttattctgttacccagactggagtgcattgcagcctcctgggctcaatcatcctcccatctcagcctcctgtgtagctgggactacaggcacacaccaccacacccagctaattttgtatttttttgtgcagttagagtttcgccatgttgtccaggctggtctttgaacttctgggcttaggtgatcagcctgcctcagtctcccaaagtgctgggattacaagcacgagccattgtgctcagccctaattctgtcatttttaatatgacatgtatctataggaatattagaaaccaatgagtatatgccttggtgtacgtctgatggtaaatagacaagggaacatagacatcaaggaacatctaaattccatgtttgttcttatcaccatcttatgctaaagagcagctggattgattcctggggccaaatattaaccaccttgttcacagctgtcacttacagatgggtggggaagcatttctatccagagcattatcactaggttccagccttttttcattctcttttcatcctttcacacttctctgggtatacctgtttttcctttttctgtgacctatagtgaaacatacatagaatagaatggaatttggagggaataaactacatacagctgagatatcttcttggtctgtttcacatgatttagtagcttagaacatggttcaagtactgagcagtttatattggtcaagatagtgtaatgattaagacccaggaaacagactgcttgggttcagatcccaaatctgtcacattcttgtgtaatctttggcaaattacaagtttaacctctgtgcttcaattaccctcatctataaagtagggagaattatagtattgtaaggattaaatgaatttataccagcaaagtgcttggagcactgcctggcagggttaccactcaataaattagccttttgactacaaatgaagaaatcaactcatactggtttaagctaaaatgggaatttttttttttttttggctaatgtaaagaaacgtctagggaaggaagagcttcaaacatggttggcctcaggtactcaaatgatgtcaccaagaaatcgctttctatcttggttccacttgactgtgtaggcttcattctcagacaggttcctttataaggttcaggatggccaccagcaatacagggcttgcttagacccttcactgggtttagcaagcccagtgaaatgaaagtacctttcctaatagttcctgtcaaaggcccaggattgtgtatctcatgttgggacttggatcgcatagcattgctgacgctgtcaacacagctgtccacatttgggttttatgcctaaccctgacagtggggtcagctctatttgaaccacctgggctaagagtaagggaagagtcgcccaaaggaaagttgagttgtcatttccaggtgaagaggcattgaattctggacaagaaaaaagtcacagttctttctatctggagaaatgaggtttttctgagagtttgttggtattttttcttatgtttaggtcttaccctccttctttcttggtagaagctatgctcatttcatgactatcttttttcccagttcagatggcatcaccttgacttgtattgtcctaaatatttttttccttcctgcactctgacctgtgacatagaaagagcttcatagatattctgacctcagtttgtttttctgttttaatctattctgacaagctttgttctctggtcttagattttagttctcctagctcgatacttcttttttctatatttagtcatccatatatcttctagacyttctatgtgtcctccttgttatagcttttaacagcccacctgatagcaaactagccrtcttaccctcttaaaacatctctgtttgggggataaagcatttatattttgcatattaaattacatttaatgctgtaactcagacttcctgttttggagattactactaaaaacgcaatcaccttttaggaaagaaattattttgtgataaatttattatttaaaaaatattgaatattgttgtttttgtaaaagttgtgtttcatttatcctaatttatgatttttttttcttgttaaaagtcagagcaacctctgtccttcccagatatggtccaccgtgcctatttaaaggacacttgagcaccaaaagtaatggtaagtgaggtgcttaaaayggcagctttgttagaagattgtctgagtgtttcctttactggcaaattatatgacatgatggaaaaattgtttcatttgacgaatatttgaacttcatattattaattttaatgaaatataggcgttcttgagattagagaattttggagtctatgatttcaaactattattgtgccctggatgtggacttggctgtctcctgctcccagctgctacagcagcccagctctacttttgccaggaaactaccctgatttaaggcatacctgccttgttaaaatggtgagtagcaggtattaaagacgcaagcactgaaaaggaaaagctgtgcagagaaaaagagcacttgaataatacatttcctattaggagcaaaggcctatgggcctctttatccaactggatttctrggtgctgtgatatttttatattttaaagctttcaaggtacatttttaaggtaggttttaaaataaatttttgtaattataccttagaagtataagtctatgtccttaggcaaaataattaaagccttattttccttatttacaggaaaaatctttgatactgttacctccaaatgtggtggaaggatctcattttcagttgcctcacttatttctttgtattacagtgtattttttaaagtttatgattgtggctatgtatgtatgtaacatatatatgtatgtaacatagccataatgataaactttaaaaactaaattttaaataaaaagttaaaactagatttaaaatatacatacatagaaatcaggataaagaacaatatgtaaagtttgctaactttcttttaaagaatatatatatagagctggtataggtatggtggttttaagtatgaggctgccttggrtcacatggaagctgcatcctttatcagcagtgtaaccttgaagatgtaactcatatctctgtgcctcagttttcacttcgattaaatgataataataatgactagataagtttatacatataaagagtttagaacaatgcatggtaaatggcatttattcagtaaatatttttagtagtggcatcaagctcgtaattattgcataggcttgtattatgcacagagtctctggaaggatgcatttaaacagtaacatagtatatttctgggaagggagactaaaggtcagggtagagaaatcrcttctttttcaaactccatatgccattttagctgttgaatttttttaaccacattgcgtgtattacttctcaaaaactgtttttaatgtttaaaaaagctttgcctatatttatattttatacttgtgtgtaagtgcttaactatttctaagatttcttttaaacagtttgaatgaggaccaaggagtttaatgtcatggaatttctttgcgattacacttgttataagatagttttagtacttcaaaaagaatstagtaaactggtatgtagatcttgttttcaggtttaagttagaaatttgcttcttggaatataatttttgtatgtagggttttgggatttggtagtcattgaatttctgaaattccgttgattragtattaacaatggtaactaattaagcaagcagctaaacatccttagttagaagattgagagctgtcaaaaaaaaaatagttctgtaaatgtaatgacagatcatatcctagaatctcttccccagagtctcaggcttgtaaaattttattctcaggaaggtttgaacccaaatggtcaatagctcattggcattatcagtgcaagattaaagcttcacatcacaatgtcatatatcaatatctctggttgaatttcagaacwttttataagaatgagttaaakaatcagtgccttgtttatctcatgatttttatattagttttaaatatataatgattatgttttaatttttagctttttgcactgactcctcttctctcagactaagcactctccagctggtcaagaatcacatggctgttcactataataaaatcctttcagccaaaggtaaaaatgtgcaaatgtgaactctctgtactcaatttaaacctccagcttcacttctcattaaaatatatctatagcaaaaatgaataccttatatatatgagaggatttgtatttgtttggtttagtgtgatacaaactattgactctaggtacttagcaaattcatacccatttttgttaactatatttgaaatctatatattgcctattttatttcgttttttatctctattgctaataatattttgttagatattgcttttaatatgaaaatatataatctgcttttttgtttacacatctatggaagttgcacaaagaagatgctatttttctgtttaatttttttcttttgtcagctttattgagataaaacttacattataaaatgcattgattataatgtgtacagataaatattttgaaaaatgaacacatttgtataaatactactacaaccatgctgtaaaacaggaatcagctaactacaccgttcaggccaaaccctcctaccacctgtttctgtacagcccatgaactaagaatggtgttcatatttttaaatggtagcaaaaaatttaaaaaaaagtattttgtgacctgaaattcaaatgtagttatccatagacaaacaatcwttttcaatcttttacatattgtctgtggcagcttttacactaaaaagcagagttgaccagttgtaacagactgtatcaccctgcaaatcctgaagcatttrctacctggccctttgtagaaaaaatttgccaacccttgatatagaaaaagtccattacctcaaagagttccccctagtcctttgccgtcagtcccctcctgacaaatccctggcaaccactgatctgctctttcgcctatagttttaccttttctataagttcatagaaatggaatcatgtatcgttttgggtctggcttttttcagttatcttaatgatcttgagactaattcacactgttctgtgtaccaccatttattcttttgtattgttaaggagtatttcatttaatgaatagaccacaatttgtttatgattcaccagttgttaaacatttggattgttttgactcacttttggccattaggaataaagctgctataaacattcacatataattttggcgcatgtgtttacgtttcactcgggtaaatttatgtgtcaggagtagaactgtgaggtaatatattaagtataagtttaattttataagaaactacagttttccagagtgaatataccatttacatttccattacttctgcacccttaccaaccsttggcgttgacagtccttttttaaccattctagtgaatatgaaatagtatcacttcatagttttagtttgcatttccctgatttctagtgatgttgccttattacttcccatctgtatatcttctttggtgaaatgactgttcaaatcttttacccattattaaaaatgggttgtttgtctctttagtattaagttgtgagtttctttatatacagattctatatcagatatatgttttgcagatatttttttcccaatctgtagctggtgttttcattttcttgttaaaattcgtattctggagaaatttttagacttacataaacatttaaaaattgtatagggagttaccatataccctgtactctgctcttccactaatgttaaaaatcttaaaaaccgtggtatagttatcaaaaccaggaaatcaatattgatgcaatcccattaactacagaccttatttgaatttcaccaatttttgactaatgtcttttaaatttttattttctcatttaaatagctaaagtttttaaattttagtttatattttatgatgcttatatttttaaatgactaaaaaaacaaaagaaaaatattttgtgacatgaaaatcgtgaagtcgtttagttttttagttttataaactaaacaggttatttcataacctgttcaagaaatatttgcctaaccttaggtcactcagaatttcttaatatgttttcttctagaagttttaaagttttagcccttacatttaaatttgcgatccattttgagttagtttttgtatatggtgtgatataagggttttgaggttttttgtttgttttgtttttttgcctcttcatatccaaatttcccagtaccatttgttgaagaggttatcttttctctatttaattgtcctagtactttttgaaagtcagttgaccatatgtgtgggtctgtttctggacttaactccttggttctgttgatctatatgtctatctttaagccccatgccacactgccttaattattgtagcattacagtaagtcttgaaatcaggtagtgtaagtcttccattttgcttttttttccccaagcttgttttgggactacattataagtatgttaagtctgtttcattttgagtagtttatattgctatgtcttcaagttcactagtattttcttctgcagtattgaatgagttattaatcccaacagtgtatttttaatcaaggatcttgtgttttccatcgctagaagtatgataaacagctgcaaggtctggaacattttgtgatttccacatttggtatttgtcatttataaatactgacaatattattaaactattacctttctctttcagctgcagtagactgctcggttccagtaagcrtgagtaccagcataaagtgtaagtaatttttggacattattacctttttaaaaaaaaattaaggtaaatatacataacataaaatttactgtcttaaccatttttaagtgtccagttcaatattaagtacattaatattgtggtacaatgataactactacctccagaactctctttatactgcaaaactgaaattcctgtgccacataaacaataatttcctcccataggccctggaaaccaacattcttttctatcactatgaatttgactactgtcaccattgtacttactatctctatgaatctattttaggtascttatataagtggaatcatatcgtgtttgttctgttgtgactggcttatttcacctagcatgatgttctcaaggttcacccatattgtaatgagtcagaatctcctttttaaaggctgaataaaattccattctgtgtatataccacattttacttatgcattcgtcagttgatggacacttgagttacagtcaccttttggctgttgtgaataaactatactgctatggacatgagtatacaaatacctcttcaagaccctccttttaaagattttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaagcaatcctcccacctcagcctcccaacagcctcccaagtaggtgggactacaggcgcaagccaccacgcacagctaattttgccacagcctttttacatagagacagggttttaccatgttgcccaggcttgkctcaaactcctgagctcaagtgatccacctgactcagtcccccaaagtgctgggattataggcgtgagccactgcacccagtgaccatattgctttctatagcagctgcaccattttccattatgactaatgatgctcaagtattcagatttccccatgtcctccccaacacttgctttttcctatttgtttaatagtagccatactaaaaggtgttgacacattgccttttgagaaagcatttctaacttaaaaattatccaaaaatacccaggcacagtggctcacacctatgggagacagaggcaagtggatcacttgagcccaggcatttaagagtagcctaggcaacatggtgaaaccctgtctcttcaaaaaatacaaaaattagctggatgtggtggcatgcaactctggtcccagctactcaggaggctaaggtgggaagattacttgagccagggaggtcaaggctgcagtaagccatgatcatgccactgcactctggcctaggtgacagggagatgctgtctcaagaaaaaaaaaaaaaaaggaaaaagaaaacccataatgttgacacaggatatatagaatccttatatatctaccctttgaccaggttatcttcatttttaaatcatcagaccaaaaatttgaaaaccctgtttaaaaatttctgaagaataccatttgaaacctttgtttttgatttcaattaagaaatgtatactttatgggaggccgaggcaggcrgatcacgaggtcaggagatcgagaccaacctggctaacagggtgaaaccccgtctctactaaaaaacaaaaaattagctgggtgtggtggtgggcacctgtagtcccagctactctggaggctgaggcaggagaatggcgtgaacccgggaggtggagcttgcagtgagcagagatcgcatcactgcactccagcctgggcgagagagcaagacaccgtctcaaaaaaaaaaaagaaatgtatcctttaaaaataggcaaaaaacatggctgtcacagcctttgattgtcgtattaatcatataaaaatcagtgttatacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacagggatgaaattggaaatcatcattctcagtaaactatcacaagaccaaaaaactaaacaccgcatattctcactcataggtgagaattgaacaatgagatcacatggacacaggaaggggaacatcacactctggggactgttgtggggtggggggaggggggagggatagcattgggagatatacctaatgctagatgacgagttagtgggtgcrgcgcaccagcgtggcacatgtatacatatgtaactaacctgcmcaatgtgcacatgtaccctaaaacttaaagtataataataaaatttttaaaaaaagataaaaaaaaatcagtgttataaattttaagtttagtgttttctaagtttctaagttttctaagttaatatttgaatttatgtagagtttgagaacatttctacattaaaaaagtaaatatcagccaggygcagtggctcatgcctgtaatcccagcactttgggaggctgaggcgggcggatcacgaggtcaggagatcgagactatcctggctaacacggtgaaaccctgtctctactaaaagtacaaaaaattagctgggcatggtggcaggcgcctgtagtcccagctgctcgggaggctgaggcaggagaatggcgtgaacccaggaggcggagcttgcagtgagccgagatgatgccactgcactccagcctgggcaacagtgcaagactccgtctcaaaaaaaaaaaaaaagaaaaaaaagtaaatatcaacctaaggttaattcatgctaaatgataaatgaataaaagcatacatagggaaatgccttttgggtgcaatctaggaaagatcacaaacagtaggaatggttaactcatctctgcttgtatatcttagttgaagagatagaaggtaggggagaaagtaactaccagctrtaggtcatagctacaaacacagtgtctgtctcaggccttgtgcttgacactttgtattctcccttttctattctttttatgtttgcaacaaaccttcgtgtaggctgtcatatttttgaaggaaaattagattcaaataattttaaaggaggaaaaaaggcatgttaggcaagagtagagacttcttagtacatatttttaaagaccagtttggtcgctacatacaagttatatgggcaagtcattttacctctgaccttccttttttgtgaaatgaaaggtaattagatgatttctaaggacccttccagatttttaatttctgtgctttacatttttttcttctgtatcatattagtaacttttttgtagcacaaaactggttcagtgtttacatgctttaaatatctggatcatttgaattaagttggttgggattacaggcgtgagccaccgcgcctggccttaaaatgatctctagagacaatgacagccattatataatttttaaagggtcaacttaacaggaagatgtaacaattatctacatacccaacatcagaactcctaaatatatcatgcaattgtggacaaatctgagggagaaattgactttaatacaataatagaagacttcaataatccactttcaatagtggatacatattataagacccagrcagaaatcatttaaaccgctgacttgaacaacataatagaccaaaggaatttaacagatatatacagacctttataccctattgaagaatacgcactcctcaagtgcacatgaaaccttcttcagaatagatctcatattaggccataaaatcagacgtaacatatttaagaagataaaaatcatttcaagtatctttttcaaccagaatggaataaaactaataattaatagctgtaagaaaatgggaaattcacaaatacatggcaactaaacaacacattcttgaacaagtattgagtcaaagaagaaataaaaacagaattttgatatcttgaggcaaaggaaaacaaaaccacartataccaaaacttacagaatgcagcaaaattagtactaagagagtggtttatagtgatgaatacttacattaaaagaggggatctcaaacaactcaactgtatacctcaaggaactagaaaaagaagaataaactaagcccacctcggtaaatccctagaaacatacaaccttcaaaaactgaatcaagaagaaatatcctgaatagactaatagaaaaaaggagattgaatcagtaatcaaaaacttcccaacagaggccacatgtggtggctcatgcctgtaatcccagcactttgggaggccaagacaggcagatcacttgaggtcaggagttcaagaccctctggccaacatggtgaaaccccgactctactaaaaaatayaaaaaattagccagatgtggtgttgcacacctgtaatcccagctactcaggaggctgaggcaggagaatcacttgaatccaggaggtggaggttgcagtgagctgagatcatgcccctgcactccagcctgggtgacagaatgggataaaatctcaaaaaaataaaattaaaaattaaaaaaaacttcccaacaaagaatagcccaggaccagatatcttcataggtaaatctaccaaatattcaaagaaaggatagcaccagtccttcttaaacttttataaaaatagaagtgggaatacctccaaactcattttatgaggctagcaccaccctgatgccaaaaccaaacaaagacaacacaagaaaagaaagctacaggccaatatatctgattgatataagtgcagaaatcttcagtaaaataccagcaaactgaattcaattgcatgttaaaagagtcaaacaccatgaccaagtcagatttatccctgggatacaaaggtggttcaacatatgcaaatcaaccaatgtgatataccacagtaacatagtgaaagattaaaaaccacacaatcatctcaatacatgcagaaaaaccatttgacaaaattcagcatccattcatgataaactctctcaacaaaataggaatagaaggaacttacttcaacagcatgaaagctatatatgaaaatctcacaggtaacatgatgcttaatgaagaaaaacaaagcttttcctctaagatctggtataaggcaaggattcctcacttttgccacttctgtttaacatagtattggaagtcctagccagagcaattagacaagaaaaagaaataaaaggcatacgaattagaaagaaagcagtagagctgggtgtggtggttcactcctgtaattgcaatactttgggggaccaaggtggagagatcacttgaggccaggagtggccagcctgggcaacatagtaagwccatgcctctacaaaataaaaaaactaaaaattaaccaggcatggtgacacatacctgtagtcctagctacattggaggctgaggcagtaggatcacttgagcccaggaattcaaggtcacagtgggctttgaccgtgccactgaattccagcttgggcagcagagaaagaccctgtctcaaaaaaaaaaaaaaaaaaaaaaaaaagtaaggttacttctgtttgtgatgacatgatatatatgtagaataccctaatgcccaataaaaaagaactgttgcaataaattcaatatagttttaggatacaaaattaatgtacaaaaaccagtggcatttctgtacacaaacaactgtctgaaaaggaaattaagaaaacaatgccatttgcaacagcaacagaaaggataaaatgcttaggaataaccttaaacaaaaaggttgaaaacttgtacactgaaaactataaaacatcaataaaggaaattttagaagacacagataaatggaagacatccatatttatgaattggaataattaatattgttataatttttgtactacccaaagtagtctataaattcactgcaatccctatagaaatcccaaagacattctttacagaaatagaacaaacaatcgtaaaattcatgtgggaccacaaaagaccacaaataaaacaatcttgagcaagaaaaacaaggctggagaaatcacactttctaaatttcaaaatatatttcaaagctacaataatcaaaacagtatggaactggcaaaaaaaacacataccagaccaatggaaaagaatggagaacccagaaataaatccatgtgtttatagtcaacttatcttcaaaagggtaccaaacacacacagtggggaaaggatagtgtcatcaatgaatgactctgggaaacctggatagtcccatgcagaaggatgaaaatggactcttaaaccatagacaaaaatcaactcatacaaaaatcagctcaaaatggatttaaaaacttaaatataaggtcctaatccataaaactactagaagagaacatagaaaaaaagcttcttggctttagtctgggcaataatatttttggatatgactctgaaagccaggcaacaaaagcaaaaatagacaagtggaattcaccaaactcaaaagcttttgtacagcaaaggaaacaatcgacagagtgcataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataagtgtatgaaaaggtgcttaacattactaattatcagggaaatgcaaatcaaaaccttaatgagatatcactcacacctgtgagaatggctatcaaaaagacaacatgtaacaagtgttggcaaggatgtggaggaaagggaacacttgtgcactgttgctaggaatgtaagttggtacagccattaggcaaatcaatatagaggctcctcgagaaattgaaaatagaactaccatacgattaagcaatcccacttctgaatatatatccaaaggaaatgaaatcagtatgtcaaggagatatctgttctcccatgtttgttacagcattatagcaaatagtcaagatatagaaacaacctaaatgttgacagatgaatggataaagaaaatgtggtatgtgtataaagaaatactacacacacatacacacaacccacaccacatttataacatacacagacacatgcaaaacccacaccacatagcctttaaaaagaaggaaatcctgtcatttctgtcatttgtgacaacacagatgaacctgagggttcattttagcttccacatataagtgagatcacgtggtacttgcctgtgtctggattattaaacatgtgtatgtgcaatctaaagtgggcaacctcagagaggcagagagtagaatggaagttgccaggggctacaggaaggaggaaatggggagatgttggtcaaagagtacaaagttttagttaatgcaagttgagtaagttctggagatctaatgtacagcattaattagagttaacagtactgtataatatacttgaaatttgctaagacagtacatctgtgttctcaccacaaaaaaaagaaaaagtagcaactatgttaggtgatagatgtattaattatcttgattatgatcattcacaatgtatatcagaatatcaaattaaatgcctgaaacatatacagtttgtctgctataccttaacaaagctgaaaaaattattacctaagcaacctgatatatatataaacttaaatagaatggccatctggtcatgactggaaagaatatattaaccagatatatttggttaatgtattgactggaccaaaagaaaaggcatatcttgttataagatagaaagactctatataatgcaaatatattgatacatactttttaaagtattgatactttttaaagtaatttctaaattcaatgtgagctcaattaagatgccaaaaatcagtattgttcatacactacttgacaaaatgttccaaaattaacctacatatatatgagaaaatagccagaaataatctgaacatgaatagaaaagagtagtagagtagccctactaagtatttaaaagtattttaggtcaggcgttgtggctcacgcctgtaatcccagcactttgggaggccaagacgggaggatcacttgaggtcatgagttcgagaccagcctggccaacataatgaaacccgttctctactaaaaatacagaaattagccaggtgtggtggcatgcacctgtagttccagctactcgggaggctgagacatgagaatcacttgaacccgggagggggaggttgcagtgagccaagatcatgccattgcactccagcctgggcaacaagagtgaaactctgtctcaaaaaaaataaagtcaaaatcacaaatttaaaatggtcatttaatttattttgctagagtaacaaaataacatttaatttagtttgctagagtttattcattgatttattcagcatatatttattgggcccctgctatgtgctagacattgttctaagggctgggactaaagaggtgaacaggacaaatttcctgcttttgtagagtttacattgtagttggagaagacaaacaataagcaaatacaaataaataaagaatatgtcatatggtaataaatgcaatggaaaaaaaatgactgagagtcccttggaggagaagcccttgctgataaggtgacaattgagcagagacctgaaagaattaaggaagaggcatgtggctatctggggaaaaagcaatccagacagaggaaacagcaagtttaaaagccttgaaatggtgtcatgattggtgttttcaaaaaacagcaaggagggctgtgtagctagtatggaataagccaactgaagagtaatagatgaagtcactgagatgggacagagggatgcagagaataaaaggcagtggccattgcaaagactttggccttcactctgaatgaaattgcaagccattggagggtcttgaagagaggagtagcagggctacttttacttttaaaagcatccctttggcttcatagttgggaatagtctgaagcagaatgactagttagaaracagtaaataatccagatgagaaataatggtgactgggaccagagtggttgcagtggagagagattgaaataatcagattctggaaacatttcaaatgtgtgtccatagtatttactgatgggttggatgtagatgtagtgtgagagagaaaagaggattgggtcaaaaatgacttccaagacttagaacctctcagccaaaaggatggagttatgatttactgaagtgagcaataccataggaaaagattgagaggagaaagcaaagcagtagttcagtgttggtcattacatttgaaataaatgcctattacatagccagttggcaacccttaggaggcagttggagtgcaagtctggaattcaagagacaatttcaggatagagctaaaaatgtgggatttgacagcatatagggggtatttaaagaattgcttgcactttttgtttttaaaatgtagatttagctagtgcttatttatccatggtattttctgcttttagtcaattaaggcaggaatttttcctttttgctacataaaccaaattgtgatggcttagagtaattgcaaatattataatcaccaagttaagtgtaattaataatcattcttcattatatatgatttttcattataatgaatttggcttagaaacaggctttctagacacataaaaagagaagtctctggatttgagccatctctgtttttataagctactctgtacttttctgtcatagcagactactgacttgatcagttcctaacctggaatatagtttattgaattatttaaataatttaatttttatagaagttttattgaaaaataatttacatactataagattcactgattttttactaaatttacagaattgtgcaaccacaaaccaattttagaacattttcatcattttatgaagatcccttgtacccatttgcagccacgctgcaaattcctacccctagccccaggcaaccactaatctactttttttttttttttagcattctattttttgttattgggaaaagaagaaattctattaaataaatatatttacaaatcaaaatgatctttaatcaatttgtaactagtttccacaattgcatttgtatacagtttctttagagaagaaaaatattgactaaaaaatgtccaggtgttctttttttattattattattatacgttaagttctgggatacatgtgcagaacatgcaggtttgttacataggtatacatgtgccatggtggtttgctgcacccatcaacctgtcatctacattaggtatttctcctaatactatcccttccccagtcccccaacaggccccagtgtgtgatgttcccctcctggtgtccatgtgttcttattgttcagctcccacttatgagtgagaacatgcagtgtttggttttctgttcctgtgttagtttgctgagaatgatagtttccagcttcatccatgttcctgcaaaggacatgaactcattcttttttatggctgcatagtattctatggtgtatatgtgccacattttctttatccagaaagaaatatacccattgatgggcatttgtgttggttccaagtctttggtattgtgaacagtgctgcaataaacatatgtgtgcatgtgtctttatagtagaatgagttataatcctttgggtatatacccagtaatgggattcctgggtcaaatggtatctctggtcctagatccttgaggaattgccacacggtcttccacaatggttgaactaatttacagtcccactaacagtgtaaaagcgttcatatttctccacatcatgtctagcatctgttgtttcctgactttttaatgatcgctattctaactggcatgagatggtatctcattgtggttttgatttgcatttctctaatgaccagtgatgattagctttttttcatgtttgttggccacatcagtgtcttcttttgaaaagtgtctgttcatatccttcgcccactttttgatagggttggttttttcttgtaaatttaagttccttgtggattctggatattagccctttgtcagatggatagattgcaaaatttttctcccattttgtgggttgtttgtccactctgatgacggtttcttttgctgtgcagaagctctttagtttaattagatcccatttgtcaattttggcttttgttgccattgcttttggtgttttagtcatgaagtctgtgcacatgcctatgtcctgaatggtattgcctaggttttcttctagggtttttatggttttaggtcttacatttaagtctttaatccatcttgagttaatttttgtataaggtgtaaggaaggggtccagtttcagttttctgcatatggctagccagttttcccaacactgtttgttaaatagggactcctttccccattgcttatttttctcagatttgtcaaagatcagatggttgtagatgtgtggcgttacttctgagacctctgttctattccattggtctatatatgtgttttggtaccagtatcatgctgttttggttactgtagccttgcagtatagtttgaagtcaggtagtgtgatgcctccagctttgttcttttggcttaggattgtcttggatatacgggccctttttttggttccatatgaaatttaaaatagtttttttctaattctgtgaagaaagtcaatggtagtttgatggggatagcactgagtctataaattactttggacagtgtggccattttcacaatattgattcttcctatccatgagcatgtaatggttttccatttgtttgtgtcctctcttatttccttgagcagtggtttgtagttctctttgaagaggtccttcacatcccttttaagttctattcttaggtattttattctctttgtagcaattgtgaatgggagttcactcatgatttggctgtctgtctgttgttggtgtatagaaatgcttgtgattttttgcacattgattttgtatcctgagactttgctgaagttacttatcagcttaaggagattttgggctgagatgatgggggtttctgaatatacaatcatgtcatctgcaaacagagacaatttgactttctctcttcctatgtgaataccctgcatttctttctcttgcctgattgccctggcctaaacttccgttactgtgttgaataggagtgatgagagagggcatccttgtcttgggccggttttcaaagggaatgcttccagcttttgtccattcagtatgatattggctgtgggtttgtcataaatagctcttattattttgagatacattctatcaacacctagtttattgagggtttttagcatgaagcgctgttgaattttgtcraaggccttttctgcatctgttgaggtaatcctgtggtttttgtcattggttctgtttatgtgatgaattatgtttattgatttgcatatgttgaagcagccttgcatcccagggatgaagccaacttgatcgtggtggataagctttttgatgtgctgctggattcgatttgctggtattttattgaggattttcacatcaatgttagtcaggaatattggcctgaaatttttttttcttgtgtctctgccagggtttggtatcaggatgatgcaaaatgagttagagaggagtccctctttgtctgttgtttggaatagcttcaaaaggaatggtaccagctcctctttgtacctatagaggaattagactgtgaatccatctggttttgggcttttttgggttggtaggctattaattactgcctcaatttcagaacttgttatgggtctattcagggattcgacttcttgtttagtctcaggaggatgtatgtgtccaggaatttatccatttcttctagattttctaatttatttgcatagaggtgtttatagtattctctggtggtagtttgtatttctgtgggatcagtggtgatatcccctttgtcgttttttattgtgcctttttgattctctattttcttctttattagtctggctagtggtctatctattttgttcatcttttcaaaaaaacagctcctggatttattgattttttgaagggtttttcacatctgtatctccttcatttctgctctgatcttagttatttcttgtcttctgctagcttttgagttagtttgctctcgctcctctagttctttaaattgtgatgttagggtgtcgattttagatctttcccactttctcctgtgggcatttagtgctgtaaatatccctctaaacactgctttagctgtgtcccagagattctggtacattgtgtctttgttctcattggtttcaaagaacttatttatttctaccttaattttgttatttacccagtagttattcaggagcaggttgttcagtttccatgtagttgtgtggctttgagtgagtttcttaatcctgagttctaatttgattgcactgtggtctgagagactgtttgttatgatttccgttcttttgcaattgctgaggagtgttttacttccaattatgtggtcaattttggaataaatgtgatatgctgctgagaagaatgtatattctgttgatttgggatggagagttctgtagatgtctagtaggtctgcttggtccagaactgagttcaagtcctgaatatccttgttaattttctgtcttgttgatctctttaatattgacagtggggtgataaagtctcccactgttattgtgtggcagtctaagtctctttgtaggtctcaagaacttggtttatgaacctgggtgctcctgtattgggtgcatatgtatttaggatagttagctcttcttgttgcattgatccctttaccattatgtaatgcccttctttgtcttttttttatctttgttggtttaaagtctgtttttttcagagactaggattgcaacccctgcgttttttgttcccttgctggtgaggagttgtgatcctttggaggagaagaggcgttctggtttttggaattttcaacctttttgcactgttttttcctcatcttcgtggatttatctacttttggtctttgctgttggtgatctttggatggggtctctgtgtggatgtcctttttgttgatgttgatgctattcctttctgtttgttagttttccttctaacagtcaggcttctctgctgcaggtctgccgtagtttgctggaggtccactccagaccctgtttgcctaggtatcaccagcggaggctgcagaacagcaaagattgctgcctgtttttccttcaggaagcttcgtcccagaggggcacccgccatatgccagccrgagctctcctgtatgaggtgtctgtcaacccctgctgggaggcatgggggtcagggacccacctgaggaggcagtctgtcccttagcagagctcaagcactggctgggagatccgctgctctcttcagagctggcaggcaggaacatttaagtctgctgaagctgtgcccacagccaccccttctcccaggtgctctgtcccagggagttttatctataagcccctgagggaggctgctgcctttctttcagagatgccctgcccagagaggaggaatctagagaggcagtctggctacagtggccttgtggcgctgtggtgggctccgcccagtctgaacttcctggcggctttgtttacactgtgagggaaaaaccacctactcaagcctcaataaggtggatgcccctccccccaccaagctctagagtcccaggtcaacttcagactgctgtgctggcagggagaatttcacgccagtggatcttagctagctgggttctatggggtggaatatgctgagctagaccattcgcctccctggcttcagacccctttccaggggagtgaatggttctgcctcactggcattccagttgccactggggtatggaaaaaaactcctatagctagctcagtgtctgcccaaacagccacccagttttgtgcttgaaacccagggccttggtggtgtaggcacctgagggaatctcctggtccgtgggttgcaaagaccatgggtaaagcatagtatctgggccagagtgcacaccgttcctcacaggatagtccctcatggcttcccttggctaggggaaggagttcccctaccccttgcgcttcctgggtgaggcaacaccacaccctgcttcagctcaccctcygtgggctgcacatatacagtatttcatcctgtatatgtaccacattttctttatccaattcaccattaatggacacccaggttggttccatatctttgctattgtggatagtgctgtgttggatatgagggcatgtgtctttttggtagaatgattttttggggggggtttatacatggtaatgggattgctgggttgaatggtaggtctatttttagttatttgagaagtcttcaaactttcctcagtggctcagtcttcagctttcctcagtggctgaactcacattcccaagaacagtgtgtaattcctttttccccgcaaccttgccacatctactattttttgacttcttagtaatagccattctggctggtatgaaatagtatctcattgtgattttatttgcatttctctgatgattagtgatgttgagtacttttttatttgttggctgcttttatgtcttcttttgataagtgtctatgtccttttctcactttttaatggggttatttgtttttcttcttgctttttyttttttttttaagttcctcatagattcttgtattagggttctctagagggacagaactaatgaaatatatatataaaggggagtttattaagtattaactcacatgatcacaaggtcccacaataggccgtctgcaggctgaggagcaaggagagccagtctgagttccacaactgaagaatttggagtccgatgtttgagggcaggaagcatccagcacaggaggaagatgtaggctgtgagagtaggccagcctcaacccttcacgtttttctgcctgctttatrttcgctcgmagctgattagatggtgcccacccagattaagggtgggtctgccttccccaacccactgactcaaatgttaatcttctttgtcagcaccctcacagatatacccagtaccaatactttgcatccttcaatccaatcaagttgacattcagtattagccatcacaattcttgatattagttttttgtcagatgcatagtttacaaatatattctcccattctgttggttgtctgtttactctgttgatagtttcttttgcattgcacaagctttttaatttaattaggtctcacttgtcaatttttgtttttgttgcaattgcttttgaggacttggtcacaaattctttgccaaggccaatgtccagcagagtatatcctaggttttcttatagaatttttatagttttaggtcttacatttaaatctttaatccatcttgtagccttgtagtgtagtttgaagtcgggtaatgtgatgcctccagttttgttctttttgcttaggactgctcttttttggttccatataaattttagaatagtattttcaatttctgtgaaaaatgatgtgagtagtttgataggaatagtgctaaatctctagattgctttgggcagtatggacattttaatgatattgactcttccaatccacgaacatggaatgtttttccgtttgtgtgtgtcagctctgatttctttcagcagtattttgtaattcttttagatatccttcacctccttagatattttcctaggtattttattttgtgtgtgtgtaactattgtaaatgagattgtgttcttgatttggctctcagcttgaatatcattggtgtatagaaatgctactgattttkgcacattgattttgtgtcctaaaactttactggaatcgtttattagttcargaagccttttggcagcatctttagggttttctaattatagaatcatatcatcaggaaagagataatttgactactacttttccaatttggatgtgttttatttctttctcttrcctaattactctggctaggactccagtagtatgttgaataagagtggtgatagtgggcatccttaygctgttccagttcaaaagaggaatgcttccagcttttgctcattcagtatgatgttggctgtggacttgtaatagatggctcttattattttgaggtatgttcttttgwtgcctaatttgttgagggtttttttttttaatcatgaaggattgctagattttattgaagstttttgctacatctgttgagatgatcataaggtttttgtttttaattctgtttatatggtgaatcgcatttattgatttgcatatgttgaaccagcctttcattccaggaatgaagcctacttgactgtggtttattaactttttgatgtgctgttggattcagtttgctactatttgttgagcatttttgtgtctatgttaatcagggatattggcctatagctttcgtttttggtgtgtctttaccagattttggtgttagaattatgctggtttcatagattgggtttcatagaatgagttagggaagagtccttcctcaagtttttggaatagtttcagtaggattaataccaactattggtatgtctggtagaatttggctgtgaatctctctggtccagggctttttatggttggtaggttttttttattactggttcgattttggaactcagtatttctcttcagggtttcaatttcttctgaattcaatattgggaaattgtatgtttccagaaatttatctatttcctctagatttcctagtttctatgcataaaagtcttcttaatagtctctaaggatcttttctatttctgtggggtctgttgtaatgttgcctttgtcatatctggttgtacttatttggatcttctcttttatctttgttaatcttgctaacagtctgttgatctgtttatcctttcaaaaaaccaactttttgtttcattgaacatttatatggattttggaatctcaatttcaattatttctgcttttagataattattttctactactagctttgggattagttcttgttattctacttcctctagttgcaatgttagattaatttgagatctttctgtcttcttgatgtaggtatttagcactgtaaacttgcctcttaacactgcttttgctgcatcccagaaattttggtatgttgtgtttctgtttttatttatttcaaagagtttttttgtttttttttaatttcaccttctgttgtttacccaaaagtcattcaggagcaagttggtttaatttccatgtaaaattatgtggttttgaggagtactcttggtattgatttctacctttttttccacygtggtccaaaaatatgtttggygtggtttcaatttttttacatttattgaaacttgctttgtcttcgagcatgtggttgatcttagagtatgttccacatgcagatgagaagaatgtttattctgtggttgttgggtggagtattcttctgtagatgtctattaggtccagttggtcaggtgtcaaatttaaatccagaatttctttgttagttttctgctttgagggtctatctaacactgccagtgggatgttgaagtcccccattattaatgtgtggctgtctaaatcttttcataggtctagaagtacttgtatgaatctgggtgctccagtgttgggtgcaaatatacctaggataggtaagtcttgtggaattgaatccttcgtcattatgtaatgcccatctttgtccttattgctgttggtttaaagtctgttttatctgatacaagaatagcaacccctgctcttctatttactgtttgcatgataggtctttcttcatcactttacttcaggcctataggtgtcattacatgtgtgatgggcctcttgaagatagtagaaggttgggtcttgttttttgtttttttttaaataaaatattattttattttttaaataaaaaaawtaaaaagtggttcttgccactctgtgccttttaactgggtacatttagaccacttacattcaaggttaatattgatatgtgaggtttgatcctgtcatggtggtgtttgctgtttgctttgtagtcttgattgcgtatttgctttataggatctgtgaacctctgtatttatgtgttcttttatggtagtgagtatcattcttatgtatgcatgtttagaacttccttgagcatttcctataggctaggtgatgtagtttgggtatttgtccccacccaaatgtcacattgaaatgtaacccctagtgttggagttggcgcctgatgggaggtgattggatcatgtctgtgaatttctcatgaatggcttagcgccacccccttgatgctgtccttgtgatagtgagtgggttcttgcaagatctggttgtttaaaagtgtatgcccccacagccttcccctctcrttcttgccatatgaaatgcacattccctcttcgccttccaccacgagcaaaagcttcctgtggtctcccctgaagcagatgctggcattgtgcttcctgtacagcctgcagaatcatgagccaattaaacttcttaccttataaattacccagtcttgggtatttctaatagcaatgcaagaacagtctaacacactaggtctagatataacaaattcctttagcgtttgcttgtcaggaaagactttatttcttctttgtttgtgaagcttagtatttggtgattacatagtcataaataacatggttaagcatttgtaaccttcatatctctgtgaataactgctaagagttgctttcttatgcccttaggcttggccagtttgtcatatcttgttggcattctttttttttttttttttttttggkaactacacaaatctcactatattgtttgtattatttaaatagttaatccatttaraatttctataaattaaatgtgttagttaatatctagaggcacatgtgaaataaataatttttaaaatgtgttagtaactctttatataggaaaataaatggatttttatttacatatcataacattttaacaagaaaaatgttccatttattactctaacaagaccaaaaaaccaattttctattttgttccatattttgaaagatttgttttcccttttagatgcagaccaacaacgaagagagaaactcaaaaaggaattagcacratgtgaaaaagagttcaaattaactaaaactgcaatgcgagccaattataaaaataattccaagtcacttttkaataccttacaaaaggtaagatagtatttttattttttaaaagcaaatgtttctaaggtacttctttagtggtacaatctgactttgtttactatagtttagggtcagcaaatttttcctgtaaagatccagatagttaatattttaaaaggctgttcaggcctctgtcacaactactctgccattggaaggcrgacatagacagtacataaataaatgagtatagccgtgttctgctgaaactttattaactgaagacattgggtcagatttggcctgaaggttatagtttgcagaccccagttataggttttttgtgataccttcgaacatctggttaaataagttctattcctagtttgtgaagtttttttttccctttctcctgaatggatattaattttatgaaatgcttttttgcatctcttggaatgatgatattatgatataatttttctcttttaatctgtgggkttttttttttttatatatatatatatagtctcactctgttgcccaggctggagtgcagtggcatgatcttggctcactacaacctccacttcctgggttgaaacaattctcctccctcagcctccccagtagctaggatcacaggcacccaccacractccagctaatttttgtgttttcagtagagatggggtctcgccatgttggccaggttggtctcaaactcctgacctcaagtgatctgcccacctcggcctcccaaaaagtgctaggattacargcatgagccactatgctgagcctcttttaatctgttaatgtaatgaattacaaacaattgactttaatgttaaaccaactttgcattcctgttgtaaacagaacttagtcatggtacattaccttttttattcattgctagatttacttactaatatttgtttagaattttggcatctgtccattattgatactggcctgtcattttctttttttgtactccttgtgtctggttatgctatcctcataaaataaactgggcactatttcttctttctgtactctagcttgtgtacatttggtttatttgttccttaaatttggtggaactcaacattaaaattgtctaggcctaaagtattttttatgagaagattttgactactgattcaattttttaagtcattatagaatgatttcaatgttagatttatgtaggaagttgttcattttatgtaaatttttggcagagaattgttcatactattctcttaatctcttctgaatatgtattatttccccttgttattcctaaggtagtttatttgtgccttcattcttcttcttcatcattctcatcagagattgagtcagtttttttaaaggacacactttttattgtgttagtcttctctattgtattttgttttctgttttgttaatatctgtgtttatctttatttccctctctctgggtttattttgctgtactatctctaattttatttaatttattaattctctgccttacttctttgctagtgtaagcatttttaatgctataaattttccaccaagtacagctttagctgcatcccacaagttttgataggtggtatttttattatgtttcaattcgaagtattttacaattttctttttgtttgtttgtttttgttttgttttttgagataatgtcttgctctgttgcccaggctggcatgcagtagtgtgatctcggctcactgcaacctccgcctcctgggttgaagcaattctcgtgcctcagcctcccaagtagctgggactacaggtgcctgccaccatgcccagctaatttttgtgtttttagtagagtctagtttcaccatgttggccaggttggtctctaactcctgacctcaagtgatctgcttgcctcagcctcccaaagtgctgggattacaggcgtgagccaccatgcccggcctacaattttcattatgatttttttatttaacccagaaatcatttagaactatttcttaatctctgtatctgctttttccttagtatctgtttgttacagatttctagcctaattgtaytgtgattaggaaacatctatattatatccatttcttgaaatttattgagcacttgttttatgtcccagtaggtggacaattttttaaaaatgtcctgtcattatatgtttgaaaataaaatatattctatagtttttgcatgtagtatttgatatatagtatattcattaaactttgtattttccagatattcaaatcttttatatcatattgattatttttgtctggttaatctatcagttattgagagaaatcttccacatacttacatatttagctatttctccttgtggtactattaatttttgatttacatattttgaatgcatgttattacattagagatattagagatacagaatacagatttagaaaatcctgaaggaggtagtttcttggtgaactgaacctgttatcactgtgctttgaatttctttaccttaatgctttttctattaatattttctgatagtgatataattaaattagctttattttgactagtatttacttggtatatcattttccattttttgatcttaatgttttcttctttttttttttttaatgtcacttgccaatctcaatgttttaggttagtatttggtgggtcagattattcaatctgataatcattgtctttttttttttttgagacagagtctcgcttttttacccaggccagactgcagtggcgctatcttggctcactgcaagctctgcctcccgggttcacgccattctcctgcctcagcctccgagtagctgggactacaggcacccgccaccacgcctggctaattttttgtatttttagtagagacggggttccaccatgttagccaggatggtctcgatctcctgacctcgtgatctgcctgcctcggcctcccaaagtgctgkgataatcattgtctttttaatggggcatttaatatgtttttatttcyggcttcttatttcataccttctatttgactcaatgtggtagacaaaatttgaagacaacacccccacagtgacccacacccttaagcaatcccctcctcttcagtgcaggtaggacctgtaacttgcttctacccagtagaatatgggaaagatgataggatgtcacttctgtgattctgttatgtggcaaaagtgaagggatattttcccctgcagattaaggtttttgttccttaaaagagaatggaaaaataagtctgggaagattttccacagtgactgctgtttctctccccaagccacaccaagagaaggtgggaaagggattctctctactcttccctataagcttcgagtaggtttcctggaggaaaagcctgcaagaggtacaaactccccaagtcctcaggtccggtacagacctgagcacatcactagtccacactcagtctttaggaaattaacaaatatttataacataatcttatcaatttatgtggcattccatggcatctttcccaagtaagcaagtgctgggatacttatctctctccatatttcaggttagttgtttgctctgtgacctcagttctctcattagttcaagaaaaatcattaatgtgcagatcgttcagcttttttcttcttgtaatggtgagagctgtgttctttccatctctatctctcagctgaaacagtaagtttgttttatttttatgtgtggtttcattttttgaacttttaaattttgaaaaccttagcatttacaaaaatatagtataataagcccacatgttcctatcacctaggttgtagcaatgatcagctcagagccagtgttatttcacctatatgcccactcactctcctaggttgttttgatgcaaaccccagacaccatataattttatccataaatatttgagtatatatctaaaagatagacttttaaaaccacaacaatactattatgccttaaaaattaataacaggctgggtgtggtggcccacacctgtaatcccagcactttgggaggccaaggtgggtggatcaccaggtcaggagatcaagaccatcctggccaacatggtgaaacctcgtctctactaaaatacaaaaaaaaattagccaggagtggtggtgcgcacttgtagtcccagctactcgggaggctgaggcaggggaatcgaacccaggaggtgggaggtctcaatgagctgagttaacgccactgcactccagcctggtgacagagcgaaactccgtctcaaaaaaaaaaataattaattaataacagttctttaataataaatatctgatgtttagatttccccactgtctcctttttgagtttgttagagttggtattagaaggccagcagtctccttcaactyagtgccagggttcaggatggggaagtttccttgcaagtcatctagttgaggagtagccattgagagaatcccagattctcaagcatgatctcttaagagctttgttttctgcccctagcacccatgatgtggtttaaaaaaaactatggactgctgggcaaaagccagattgactgctctgcttaccaaataccaaggctgtaataatgagtctggatttttttccttgagaaatgctgggagccatagaccagtttttagttgggaagttatgtcatcatactgacactacacagactacactgacaacagtggaggacagttacgagacagttgcagtaatctgggaagcagtaattaagacatgattctatgacagcagagagagcataaggaatacatttaagaaataattagaaagtagaatctcggccgggcgtggtggctcatggctgtaatcccagcactttgggaggctgaggcrggcggatcacaaggtcaggagttcgagaccagcctggccaatatggtgaaaccctgtctctgctaaaaatacaaaaattagctgggcatggtggcatgcacctgtactcctasctactcaggaggctgaggcagaasaatcgcttgagtccaggaggcggggttgcagtgagccaagattgtgccactgcactccagcctgggcgacagagcgagactccatctcaaaaaaaaaaaaaaaaagtagaatctgcaggacttggtgactgagtggatgatgtgaagagtaagaagcaggagttaaaatcctaagtttctgccttgggcaactgggagaatagtaatatatcattcacagaaatataataggatgaggtgcaggttttctttggggctggaggtaataagagataggagtttattgtttggctgtgtttgatttgagatgcttttggaacatctagtatatttagtagacacttggatataagcatctgtgtcagcaaagaggtctgggctgaaaatagacttgggagtcatcaggggaagcagtgaatatgattgagagccccagggctattatgtagataaaaagaccagcaatagagctgcttcctttagaataaatctgttatctgctctgtattatactttgctatctgggattctgttcctcaatatttgaatcacaggtgtattttcatttttagtgattgtactttttaacagaaaatttaaaatttgtttctattattcagcatgagtataaattactaattaaattttgagataagaatggggtttcttgaaaatacaaatcatatattttaatatatctttttaatgtattttatatatctatttatatataataaagtaaaaatatatattatttacatattatatatttttaatatatttctgtaaatgttagatgttttcatttttccaatagcaactataaccctatataactttttgcctccataaagttgttaatttattattttatctgtatttttattgactccatttaggattcatagtaacttgcactttgcctacatttttgataagccctgataataaatattttagatacactcagattgtcttaagagccttattttgggtagtatattttgataattgaatgggtgttatggttaacagacacctgttatggttataatttgtattcactgtaaaggctgctatagttaaaatgctggctttaacctctgaatgtattagccctttatatacattataaaggtcatatatcaaaaaccttttatgataattgcccaattctcttgccacttttcttctcccatactctgactcacatgctgtcaccctcagaaccctcctaagcccttccagtcttcaccctgtaactcttgagtcattcactacttagtcaatgctcccatactactcgtttgcttcactggtgtagcacttactgygtgcttttaagattaagtgaatatgtgggtgtgagctttatttctgaataaatctagaaaagaggcgggagcagtggctcacacctgtgatcccaacactttgagagactgaggcagacagatcacttgagcccaggagtttgagaccagcctggacaacatggcaaaaccccatctctacaaaaaaaaaaaaaaaaatacaagaaaaaaaaaaaagccaggcatgatggtgtgtatctgttgtcccagctactcaggaggctgaggcaggcagattaattgagcccaggaggtcgtggctgcagtgagccatgatcaggccactgcactccagcctgggtaacaaagtaagattaaaaaaaaaaaatctgggaaactttttaaaaacagtacaaaatagtgaaaatcaagagctatatttgttttataaaatataatttgaaacttttttgcaaacagatgttagattttaaaataatttatacccatccaattctacaattgaattgactcttcaagtgtttaaaaatccgacaattggaaaattattgtaggttatgtcttctgacatccttaaaaaagattgatttagtactgagttctgtattgtaaaattcttgacatgaaagtatgatgagtatataaactatgttatggttattactttacataaatcttgaaatcacagaaacagtgcacaacaaacctcgtaaactaagaataacctaagaaagtgagtgttcagggtaccaccagactctttgytccattggcacataattgatgaacccttttctgatttcagaactttacagtgatctgctgttcatgttttgggattctaccagtgtgttacatatattctgcacaaatatctttatccaagtttcatgatattcatagctaaaggaaacaagatgcagattggtacagtggattttatactgtagtctactggtttccaaggaaagaaaaaataggatacaaggtagaaattataagatacaaaaatgggaaaagtttcatgctttctataagttcagaagcaatttttccatcccatttcagagagatagcttaacatatacttctaccttttaaaaagactttcttcagtgtttcattttgtttattaaataaccattaccgataacatttctttacaggcaatcataatggcttatgcatttctttctccttcctctgatctyagtttgtgctgttcttctaagtgtaaataattcctgtgcttattaattaattgccctataggatatttttagactgtacttagaaatttcttctttgagagctaaactcttctggtacataagctgtagtgtgagtatcatttaggactacttataaaaactaacatcttgaagtcatttaccaaatagtaccctagtgactcaaaatttaatgccagcatacttacttgctttgagtaatgttgtcttgtatttggaataaggttataaaacagttggaaaggaaaggtgatttgacatattttagatagtagtcacaatgtccagttatctgcaatttttttgctttgataaatcagcactttaggttagctgacttatttgttcccagaaaaagagttaaaatcagtttaaaattttttatgctgtaaaaaaaatctaaaatcatataattttcaaataagtttttaagtagacaatatgataaagtggcaaagaacatgggctctgcctctgttcaaatctgtgagacactgcacctcagagcagtgtttttatctacaaaatagggtaataattgtactacctctcagaagttgatgttaggattaaatgagctatacatgaaaatgagtacagtaccttgcacatagtaagcacaccatacatattagtagcagtgatagaagttcttattattcctcttctattcaatgtcaagagcagtacctttcatacaggaagcctttttccttactcaacttgtccatcttccccttgttattcctcccaatgaggtaataagacagatataattggctaaatcctagcgatttttaacctcaatttctgtaacctccatgtaatttcccctctacctaatgaaagtgcctcagagttttgcaaaggatatacagatgtgtccgtaagggctgaagtcataggcaaagcttcttagacattttcagtttataaaacaataaaatactatctgtgtttttagactttacaaataacctgtagaaatggttttcctaaagtaaagccaaaaagaaatggagcaagtcaaaatgcctcccttttcawagtattacccccaccccaatgaaaagaagttgagaaatatatatgaaattattatggaataaatatttattaattatatttaaattatcaattacctaaatcagggctccatacattatgaggagaagttccttttcgtttctttaaaggcttaacatcacaaagggatggcttacactgcactctccaataatgacaagacaggacagtgaggatgatgtcactaatagtggttgagaagggcattggtgctcacaatttgtgtggaagctttcagataaaactgacatctcccaataaatcttaatatgcaagttgaagatcccaaatatagatatgttattcatctttttttcgtttcagaaaggaaattgattgctctattacttatatttggaattaaatgttaatatcttagtttaaatacttgactagaacttcarataaaatattaacatcttcaggaacatatcagttaattttgtaaacccttgaggctatcatttttttaatgtataatctcaaaatccccaattacatgaattcgtaatgcagttgatgactgtcatatcgaatgttcttagccctcaggcgaaccgcaaattgaggatgacatgttaaaagaagaaatgaatggattttcatcctttgcaaggtcactagtaccctcttcagagagactacacctaagtctacataaatccartaaagtcatcacaaatggtcctgagaagaactccagttcctccccgtccagygtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacrgatagaagctgaaacccagactgaattaaggtatgacacatcagcaaccaacagtaaatccttcaggaaattaaatgaaaattaatgaattaatattccttgttttctgctgccagccttaagatctgatagtgcccttttgattggaatgagatgaatgtgacttttccttttccatgtatcactagaactatcagagtaattgctgaaaaatagctattaaactggtcaagcaccttatgcgtatgaattacatattttattatttcaagcgtggttcaagaattgtgtatgtttttaaatattatactttcagagaattcttaaaataggtcatcagacagcatttgtggaaatatgcatattgattcatgttaaaagtggcgaaacaatgggctatagaggggaagaaactaaccctttatccatctaaccctctgctccatttcctgcagatattccggccagtcttcatagcaacaactgccaagaataattttaaattgggataatttctagaaattaagtataatttgcctcaataatgttttcaaatacagtagtgcctggcacaagatgaatgttcaataaaagtttgccagatgactaaagaaaaaaacaaatcttgtcaagttttgagatttagcagatttgtgattgtgattgtttttctagtattacataaacaatttatctggcagtaggttttagttgttttagaaagtaaaaacaatttaagattagtatttttttctttgaatatagrtaagtacagtgatatcagatgagtctgcagatatttaatcaaataaaatcaaataattcaaaattatgtattttataagaatagatggrtctcattctttttgagtttattttttctagccagtaaaccttgttaccacagtgcttatattttgaaggattaacaattatttattttaaattattacagctttaaatctgagttggggacagctgagactaaaaacatgacagattcagaaatgaacataaagcaggtaataagtatgaaatcttttggtattgctacatttgaattacagatgtttttcagtaaatagaatatgtacagctatttagactgtgaagaataatctgttggtggcacttatcatacatgatatagccagtatacagaaggtctgcctatttacaaatggttatagckctctctgaatggccaggtggatcctgccaaatctgggaagtcatttgttactaacatctttcctagatgattggttggctggctggacaaatggaaggatcagtaaaataccttaagtattgttttcaaagatgcagacctggattactagaggagccagcagagtagtgcagaagttgagtttttataccttttttttttttgtaaagaattgccacatattatataattggaaattatacattttataagaataagtagctgttattctcttatgtttgcctctgctttttctagaccatgaagctgtttattacagggtttatattttgaattcttagcatcatttcttttaaaatattgcaactttgagtctgattttgagataaattgttttatttttggagtttcagtcttgcacttgtgtcctgacttaaatttgttgcttataaaaatggtttgtctattaaaatgtcaaacacagatccagagatagaagaataaaatataatcatactcaacttcccccttcccttctgaaaatgggtagaaggtggtagttttccatctcagctattaatcgctgtttgacatagggccctgccacttaaggcccaaggacaaatcacttatcctctgagagctgaatttcctcatctagaaaaactgtacttaacttgcaggattattaggaggagtaaatgatgtaggcaaagtgcctagcctggtaagggcttaataaatgatagctattactagcttgaaatttttggaaagagttagctttgcagataactacgtaaacatgaaaaaatatttatttacaatcctgcaagaaaatgtgtgtccccatattccatagatagtgccatcagtacttgacttgaagaagccagtagagtattaactgcagtagatccatattttaacagcacctttaaaactgtaaagcactatacataaattgtcattgtaaagattgaatctaatgatgtgagtaaatgcttggcacagtttgtggtgtgtagtaaggagtctataaaagtaagctgccattatttttgtttgttaatattattgttcatgctgccagcgctaccactgcttctacatatttgacatgttggcatttaaaacagatgagctatttgaatttctgaataatgagattttgttccctcaaacttacttaaaagttgaaaatttgcttcatttttccctttatatgtttatttgtggcaatttcttaatgtcatttaaatgccactcattaaaatacaagaaataagtcattttatctttaagtttaagaaaaaagtgctggatggatagaaaaattattctaaaatattctttgtcgtactgtataatttttatctactggatatctctgttcaatcacttaaaatttgctgtgttatattctgctttcgtaatgtatttttaagcaaaaataaakattttttttattgcatccccaggcatctaattgtgtgacatatgatgccaaagaaaaaatagctcctttacctttagaagggcatgactcaacatgggatgagattaaggatgatgctcttcagcattcctcaccaaggtaaacagttcacaggagaaataatttcaactgtctttaattgccttcttgtataacagacatatagtatttgccgcataagtactatttaattgcatgctccaatctattttggtgttatgtaattcaataacagttttagttttaccaaggaaattttacaaattgaagtgcttagtaaaagttgaaatgaattaattttgctaattcattagtaaaggaaaaaaccacaccaacttgtattatttattatcactgttcattaaaaaaatgattttccccaagacaagtcctctggcagtgatgctaaccagtttacatgccacaaatagtactgaagagctttaccatttgaggagtcataatttgtgattttgaatattcatcatatcctagtgcttgaccaatctgtgctatatgaagacactatttatttatttatttatttatttatttatttatttatttatgagacagtctctctctgttgtccaggctggagtgcagtggtgcggtctcagctcactgcaatggaggcactctttaaaaactactcatcatgttgagtaattaaggaatattatacattaattagcaggtagtagaaaacctaaaagatgcctcgatagtttcagttgtcaaatgtatttccagtgtcagagagtggatatgaaatgccggtggaaggggtagaagaaaggaaggagtagagattaaaaagagggcaagaataaggtgttagtagcagaccactagggaagtacacacaatcccctcaggctctggcttctccctcargcctttgctagggagatctcacctgctaaggccatggagagttcattgttaactaccctgtctttgaaatttctgatgtttcaacacatataacttattatttattaatataactgctcttgagccagtcttcattgaatattaagaatgacttaaggaaaggaatatttatcttttctaatactttctaaaagaagtaaagtagaatagtatagttgagtatacctgaataaaatttagcttcaaattaattattggtaacataactgaataataacaaaatttatcatgatgaccacctttaaaaatattttcataataatgtatctatatccagcattatctatacattaaccttagtcaaattgtcattgtttatactagagaagtgccgtagtgtagttttaaaaagaattgtgaatttatacctagaaaagtagtttaaaaacctgtctttgctgcttactaacattaaccttggaaagttacttagcctttctgacccttggtgaactaatcagtaaatgggaaaaataatacacagcccacatgcctgactgggttgtttagaagattaaattagatatgggtatgagagtgctttaaaaattgctgaaacatgtaattacaggttgagcatcccaaatttgaaaatctgtaattcaccatactccaaaatccgacatgatgcccaaaggaaatgctcattggaacatttttggatttcagatttttggattgagatgctcaactactaagtatataatggaaatattccaaaatccaaattctgaaacacttctggttccaaacatctaagataagggctattcagtgtgtactaatatacaatgttattgagtacttattgtatgccaaccactgttttgctcaactactttaacttcctctttctagggcaatgtgtcagtattccctgaagcccccttcaactcgtaaaatctactctgagtaagatcttttttaagtcttcgttttgcatagtggaatcaaggattaagaatcaaagaaaccatattaaataagtcaggattgaacaataatctctttttttaaaactggcaagtaataaatgtacatattcatggagtacctagtgatattttgatacatatactgtacagtgattagaacagtttaattagcatatccatcatctcgaacattttatcatttctttgtgttggaaacattgagtatccttcttctagctatttgaaactatgtattattgttaaccatggtagtcatcctatagtggtatagaacactagaacttactcctcctatctagctataattttgtatcttgtaacaaatctcagcttgtccctcattcccgtctacccttcccagcctccagtaccttctgttctactttctacttctatgaaatcaactgtttttagcttccacatatgagtgagaacatgcgatgtttaactttctgttgctggcttatttcaccagcatccatccatgttccatccatgttgccacaaatgacatgattttatttgtttttatggvtgaatagtatttcatggtgtatatatacattttctttatccattcatctgtgaacactaatctctcttacaaccagctttgggatatcaatcgtataatacatactaaatttgagaaactgacctgaataattttctcgaatttttttgagaaataataacaactttctggaataattatcaatcacgtcatttttatctccagtagaaatttgtccccaggtattacctgatactttttaataatcagtatccatgattcttacttattttttaagtaaaaataataaaataataaagaagagttttagagaaatgcagacttttaatagttcaggatactctttccagaggtttctaacctcagcagttctttgcagatattttatttgtagattttaatgttgttttaattaagttactctttttagggaaaataatttataaaattttatttattttcaaatatgctgtttttaaataagcaagaccctgtgaatcagtttgaaagtgtaactttttattaaacatttaaatctattatttgatttgcttattaactcttcccttatatttgcttattcagtaatttagttacttgctacttacatttggtattaattcactaatttcagctaattaaaatcaaacgtacaataatatcctaattttcttgtaatagctactaaaatatagttataatagagaagtgtgttcaagtagttaaaaattaccacaagatttatgttcacaaattttcctatgagaatttttcgtctccaaacgttttgagagaaaaaataaatttttctgcttagtaaatttctcaaccttaaaacaagatgctggcctagggctaggagaggacttcttagttgwagctcctgcttctctggacaactttcctcttccttcttgcaaatgctttgcagagggacttgcacctctgctgctggacctggtcaggagcaagaggaaatttaaaacattcctcgggagtgcttgctcccagtggattgcatttgattgcgccttgtccttcgttgctttctttttgtgttgtttaattctgcttgttttttactgctatggatgttgcagatatctgtgaaattttactctattaggtcatcacctttagtaaatatttatccttgcataatttgagaaggtagacatgtttgttttgtaatattccccttagtaatatgagatagaagtacattggtaatggtagagatagatatttctaattaggtactaatgtttcttacagttttcagaataagtaagraataatttttatgctatatattgccttccttttacagtgaagaagaactgttgtatctgagtttcattgaagatgtaacagatgaaattttgaaacttggtttattttcaaacaggttagtttttttaatggtgttatgttaattcaggagtacattaaatattcttcatatttcttcatatgatgttaaaattttaaagttattttcccatattaggaaatgaaaaaatatattgctttcttggaaacttattattataattgatagcaagttgtaaagaatgtttaattcatactctaggggaagttcaccacttgggagaattaaagaatagagcttttattcattttaatattatatcccttgagttataagtgactagtgaaggaagatctttatcacttatttgcaaagctccataatcccattttactacctaaaattgtcatgagaatcaaaagcaagcatttttggtgcaaccattattagtattagatctagtaaaatgagaacaaattaagagctaggtttgcacgctgtaagttaaatggaaagtttgcaaaaccagattagctattgcatagcttaaggaaactgtgtgtcctgaattttgcttgaacatttatgtatctaagattcattgagcaytgagctctactttgtgttatgtaacctaggaccctattatgtatactacttgctttctctgtcataataatatgccaagcatagacatttttaataaattatttctatcctctacatcaagttttttaaaaaattaaagcaaacattttcattattggtataaaaaggcatatcaaaaagacctaagatttttggcattaattctgttgacccctttcattttaaaaagttggttaataatatttgcataatatgggtaaagagtttcaggatacataatgaaaagttttggcaatctgtatcacaatatgaatatacctaacactgctgaatcgtgcacttaaaaatggttaagatgataagtttggttagtttttgccaccacaagaaaaaaagtacacatacaaaatcatatgtatttatgcttaaaattttatgtttttctcaagattataagactgtttattacagcatttttataattgtaccaaaaaccagaatcaacctaaatgtttaatggtaaatgtttggttgaataaactgtggaatatatatgaaatgtgaggtctgtttagggattaaaaatgatgttgaagtgaatttacagatatagaaagatgttaaagatatatgtcattgattagaaaaaacaaaatagggctgggcgcagtggctcacaccagtaatcccagcactttgggaggctaaggtgggcggatcacaaggtcaggagttcaacaccagcctggccaatatggtgaaaccycatctctactaaaaatacaaaaattagctgggcgtggtggtgcrcgcctgtagtcccagctactcaggagggtgaggcaggagaatcrcttgaaccccgcaaggcggaggttgcagtgagctgagatcgygccaccrcactccatcttgggcgacagagtgagactctgtctcagaaaaaaaaaaaaaaagaaaaagaaaaaagaaaaaacaagatagatacccaaatagtatgtattgtttaattacaagttggtaaagaaatacaaatgaatagaaaaaatgcctagtagtgaatattctaaaatgttaacaatagttgtaaaaagtagaatacagatttcttgggttttaawaaaaaattgtgaaataattcagaactactaactctgaggttggttcataacttcactgatgctagcaaatgataacaaaggaaattagttgttttttaagaaactgttgatacattcctgtgatagagaggtgagcatggtgttctagaatgaagaaattctgtggagccagacacatctgggttaaattctcctaaaggcttttgacctcaggggagaggaaattatcatcttagagatgtggctttctcgtctttaaaatggtttttacactatctttccctccctacattggtcagaactagaggtaaaatgattattatgactagcacagtagcacttaatggaaattaataggtgataacttttaaattattatgtggatttaccatcagtgggagtttttaaattttttaattattttttaaaattttgtgaggtacacagtaggtatgtatatttaaggggtacatgagatgttttgatacaggcaagcattgtgaaataagaacgtcacggagagtggggtatccatcctctcaagcatttatcctttgagttacaaacgatcagattacattctctaagttattttaaatgtacaattaagttactattgactgtagtcaccctgttgtgctgtcaaatggtcttattcattctttctatgtttttgtacccattaactaccccacttaacctgcagccctctactacccttcccagcctctgttaaccatccttctactctctatgcccatgagttcaattgttttgatttttagatcccacaaatacgtgggagaatgcaatgtttgtctttctgtgccaggctcatttcacttaatataatgatctccagttccgtccatattgttgcagatgacaggatctcacttttttaatggctgaatagtactccatggtgtatatgtactacgtttttttatccattcatttgttaatggacacttagttgcttccaaatcttagctgtcataaacagtgctacgacaaacataagagtgcaggtatctcttcgatatcctgacttacttccttttgggattgctggaacatatggtagctcaatttctagttttttgagggacctccaaactgttctccatagtggttgaactaatagtttacattcttaccaacagtgtgcaaggattcccttttctccacatcctcaccagcatttattattgcttgtttttgcatataagccattttaactggagtgagatgatacctcattgtagttttgatttgcattcctctgatgatcagtgatgtgtggaataccttttcatattcctgtctacaattcgtatgtcttttgagaattgtctattcaaatcttttgcccattttttgattgggttattagatttttccctataaatctaatagtaaatagttgtttgagctccttatatattctggttattaattccttgtcagaggggtagtttgcaaatattttctcccattctgtggattgtctcttcactttgttggttatatcctttgctgtgtggaagctttttaatttgtgatcccatttgtccatgtttgctttggttgcctgtgcttgtgggatattactcaagaagtctttgccagaccagtgtcctagagattttccctcaatgttttcatttagtagttccatagtttcagaacttatatttaagcctttcatctattttgatttgatttttgtatgtggtgagagataggggtctagtttcattcttttgcatatgggtatccagttttcccattaccatttattgaagagactgccttttccccagtgtatgtatgttcttggcaactttgtcaaaaatgagttcactataggtgtgtggatttgtttctgagttctctattctgttccattggtctgtgtctgtttttatgcctgaccatgctgttttggttactgtagctctgtactgtaatttgaagtcaggtaacatgattccaccagttttgttctttttacttaggatagctttggctattctgggtcttttgtagtttcatgtacattttaggatttttttttctatttctgtgaataatgtcactggtattttgatagggattgcattgactctgtagattgctttgggtggtgtggacattttaacaatattgattcttccaatccatgaatttggaatatttttccttttttttttttggtgtccttttccattttgttcattggtgttttatactttaatataggaatttttaaaagtataatttaggaaggattataaaatatctctgtaagaggtttttctttagggtttggttgtgtgtgtgtgtgtgtgtgtaaatatcggggtagagaggctttgggtgtttgcatatgtctgtgagagaaaaacagctttttggtggtggggtgagaaaaaggagaattttattcaaagaaataaaagtagcatacagtctttcagaaatatgtaatgtgaagcaaatgcataatggaagaacttagaacaggaaaggattagtcttcagctttacagagaaaaagaaaaatctgaaaaacatttttcaacctttgtagtttcagtgttacgtrgctagtttatatttagatgattttctgattttgagacattaacatttttgtttatcatttgtaggtttttagaacgactgttcgagcgacatataaaacaaaataaacatttggaggaggtttgtctttccttataacttcattagaaaaattataatgtaaaaataattktatggtttttttcataccttcaaacaatacattaaaagcaagkgctttttttttcccttgaacttttttgagggtggtggtgggagaagtgaaaggaaaagtattaatcctgtgagattttcagcactgcagtcaaaatttaatttgactcaattaatgtaattagtctcatcttttcttaatcctaggaaaaaatgcgccacctgctgcatgtcctgaaagtagacttaggctgcacatcgraggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcrggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaatattacttttcttccttttttaaaatgtatgtataagatttctctattggttttctgtgctgcaataataagttaccagaaacctagcggcctaatgtgccacacatttattatttatcccacagttttgtggatcaggagtgtaggcacagcttagttgggtcctctgtcctgggtctcacaaggctaccccacaatcaaggcagtggctggggccatgttttcattaagaggcttgttggcagaattatcctccttgcagttatagatttgagggcttcgttgtcttgctgaccagtggctagaggctgcctatagttctctgccacttggccctttccttagggaaattataacgtggctgcttgcttttttaaggatatcaggaaaaccagagagattctgctaacaagatggagtcttatataatgtaacataatcacaggagtgactttctatcacctttaccgtgttcttttgggtagaagcaagtcacaggtcttgcccacacttaagggttgggaatatatacaagggtgtgaatgccagaacacaggaatcactggggtcatctgaggacctgctggccacaatttctaaaatcacttttcagaggaaaacatattttacctatattttcagaggaacatattttacccagacataagcggttttgtaggctatgggaaatggtttatgatctggtgtgagtcttgaagcgttggaccttgtctgcaatatctttaattttgtttttctcacttttcctgcaatatctaaagcctcaaggacctttcagttgtcagtgacccagggaattctgtcagctggctgagatgttgtctcttgtkgtgagtgcaaacatttagtcagacctgtctgaagccctctcctacccttgtagctcatgaatgagacccttactattagaacatggcccagcagattcatctctaattatacctttttaactatttacaataatataattgaatatttgtgtgcccrttatgtacaaagtttcatgcctagatactgtggaggataaaaacaataacccattttgtttttataagctatattttaattttatatttaaaaaaatacaacccaggtattcttctaaaaacttaacagtgacttccaagtatcctgttctttaactcgggtttttatcatcctttggccatagcagtgtttcccaaagggtggtacttaccactggagacctgagagttgattttagtggtatgtggatgacaggtccatctcattcatgggatgctgaccatcaccactgtcttcaggataagacacaggtacaacctgcaaagcacaatatggtgggactgagcacccaacccacttttcacctccactgtcggaatccccaactcaccctgctacaacccttttttggcacaccttcccctcagccctcacctctggacttcttccctttaaccctgtaagcaacaccgtctatcccctcttgcagtcctcttaaacctcctgaaataaccttggctctattcttggtccccagcctgggtctccccatctgttagatctttacccctctagttgcttcttgggttctgttgttcctcagccccagggttcctttcttcagtcccagcctcactctttcacaaaccccctcttcccattccccatgtaactaccccagacctactggcctggcccaaattttccttccttggctggagctaccatctgtctttccggaggcattctcagaaactatctcctggctgctgttctccaacactttggtccaagccccagacctgccctatttgacattcagtcttcatgctctaactctgggtacagcttcttgtctctggggccatgacccatcctaatttggatacctattaggacaatttgttgttatcctttagtttccctttaagttttaaaaggtgagttgatttaaagaaatattaaaaatggttcttgaatgtggcaaaagtattatagtatgaaggtaggatgtgggtggtaagtttgggaaacagcacttaaactcttctagcagcatctttttttatccctaagacatcttgttacagcatcaagcaacatctttatatcttcccctcttccttctcacacagcccatcaactgaggctgagaggcatgatgaatgcgagtgtgtcttctgagccaggttgcctggatttgattccttttgagctgtgactttgagctgggttactgagcctgtgtgtgttttctcatatcttggagaggggtaattatagagcctttatcatagaatacaagaattaaatgagcttgcatgataaatacaggctgctgctacttttttttttgctatttattttttatttcagtaggattttgggaacaggtgatgtttggttacatgaataagttcttcattggtgacttctgagattttggtgcacccagcacctaagcagtgtacattgtacccaatgtgtagtcttttatccctcactccccgcctaccctttcccctcagcccccaaagtccattgtattattcttatgcctttgcatcctcatagcttagctcccacttatgagtgagaacatacaatgtttggttttccattcctgagttacttcacttagaataatggtctccaatwccatctaggttgctgcaaatgccattatttcattcctttttatggctgagtagtattcaattgtgtgtgtgtgtgtgtatatatatacacacatcacattttcattatccacttgttgatcgatgggcatatgggctggttccatatttttgcaattgtgaattgtactcctataaacatgcgtgtgcaagttatcttttttgtataatgacttcttttcctctgggtagatacccaggagtgggattgctggatcaaatggtagatctacctttagttctttaaggaatctccacactgttttccatagtggttgcactagtatacattcccactaacagtgtaaaagtgttccctgttcaccacatccacaccaatatctactatttttttattttttgattatggccattcttggaacagtaaggtggtatcgcgttgtggttttgatttgcagttccttgataattagtgatgttgaacattttttcatatgtttattggctatttgtatatcttcttttgagaattgtctattcatgtccttagcccattgttgatgggattgtttttgtttcttgctgatttgtttgagttacttgtagattctggatattagtcctttgtcagatgtatagattgcaaagattttcttcactctgtgggttgtctgtttactgattatttcttttgctatgcagaatcattttagtttacctaagtatcatctgtttatctctgtttttgatgcatttgcgtttgggttcttggtcatgaacactttgcctaagccagtgtctagaaaggcttttctgatgttatattctagaatttttatagtttcaggtcttagatttaagtctttgatccatcttgagttgatttttccataaggtgagagatgaggatcgagtttcattcttctacacgtggcttaccaattgtcccagcaccatttgttgaatagctttgttgacagtcagctgactgcaaatatgtggctacatttctgggttgtttattccattcctttggtctatatgcctgtttgtttgtttgtttgtttgtttgtttgtttgtttttgaggcagagtctcactctgtcacccaggctggagtgcagtggtgtgatctgggctcactgcaacttctgcctcctgggttcaagcgattctccgacctcagcctcccaagtagctgagattacaggcacctgccaccatgcccagctaatttttgtagttttagtttgtagtttgtaattttagtagagacggggtttcaccatgtgggccatgttggccaggctgtctcaaactccagcatagaaggtatgttccttctatgctgattttgctgagggttttaatcataaagggatgctggattttgtcaaatgctttatctggtctattcagatgatcatgtgatttttgtttttaattctgtttatgtggtatatcacatttattgattttcagatgttaaaccatccctgcagccctggtatgaaacccacttgatcgtgatggattatctttttgatatgctgttggattcggttagctaggatttcgttgaggatttttgcatctgtgttcatcagggatgttggtccatagttttgtttttttgatatgtcctttcctggttttggtattagggtgatcatggcttcatagaatgatttagggaggattccctctttatcttttggaatagtgtccataggattggtaccaattcttctttgaatgtctgatagaattcagctgtgaattcatctggtcctggaatttttgkttttttgttagtaattttttttttttttttttgagatagagtctcgctctgtcacctaggctggagtgcagtggtgcgatctcagctcactgctgcaacctctgcctcttggtttcaagcaactctcctgcctcagcctcccaagtagctggaattacaggtgcctgccactgcgcccagctaatttttgtatttttagtagagacatggtttcaccatgttggccagactggtcttgaactcctgacctcgtggtccacccgccttggcctcccaaagtgttgggattacaggcgtgagccactgtgcccagcctatttttgttggtaatttttaaattaccatttcaatctcactgctcgttattggtctgtttagagttttctgtttcttcctgtttaatctaggagggttgtatatttccaggaatgtatccatctcctctaggttttctagtttatgcatgtaaagctgttcatagtagccttgaatcatcttttttgtttctgtggtatcggttgtaatatgtcctgcttatttcttgtatttatttatttatttattattattatactttaagttttagggtacatgtgcacaatgtgcaggttagttacatatgtatacatgtgccatgctggtgcgctgcacccactaactggtcatctagcattaggtatatctcccaatgccatccctcccccgaccccacgaccccacaacagttcccagagtgtgatgttccctttcctgtgtccatgtgttctcattgttcaattcccacctatgagtgagaacatgtggtgtttggttttctgtccttgagatagtttgctcagaatgatggtttccagcttcatccatgttcccacaaaggacataaactcatccttttttatggctgcatagtattgcatggtgtgtatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatatctctgatggccagtgatggtgagcagtttttcatgtgttttttggctgcataaatgtcttcttttgagaagtgtctgttcatgtcctttgcccactttttaatggggttgtttgtttttttcttgtaaatttgtttgagttcgttgtagattctggatattagccctttgtcagatgagtaggttgtgaaaattttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcctgaactgattttcgtataaggtgtaaggaagggatccagtttcagctttctacatatggctagccagttttcccagcaccatttattaaatagggaatcctttccccattgcttgttttcctcaggtttgtcaaagatcagatagttgtagatatgcggcgttatttctgaggcctctgttctgttccattgatctatatctctgttttggtaccagtaccatgctgtttttgttactgtagccttgtagtatagtatgaagtcaggtagtgtgatgcctccagctttgttcttttggcttaggattgacttggcgatgcaggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatccagagactttgctgaagttgcttatcagcttaaggagattttgggctgagacaatggggttttctagatatacaatcatgtcatctgcaaacagggacagtttgacttcctcttttcctaactgaataccctttatttccttctcctgcccaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagtatgaaaggttgttgaattttgtcaaaggccttttctgcatctattgagataatcatgtgttttttgtctttggttctgtttatatgctggattacctttattgatttgcgtatattgaaccagccttgcatcccagggatgaagcccacttgatcatggtggataagctttttgatgtgctgctggattcggtttgccagtattttattgaggatttttgtatcaatgttcatcaaggatattggtctaaaattctcttttttggttgtatctctgtccggctttggtatcaggatgatgctggcctcataaaatgagttagggaggattccctctttttctatggattggaatagtttcagaaggaatggtaccagttcctccttgtacctctggtagaattcggctgtgaatccatctggtcctggactctttggttggtaagctattgattattgccacaatttcagatcctgttattggtctattcagagattcaacttttcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctctttttttgtttattagtcttgctagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttggatgcgtcccagagattctggtatgtggtgtctttgttctcgttggtttcaaagaacatctttatttctgccttcgttttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgttgaggagagctttacttccaagtatgtggtcaattttggaataggtgtggtgtggtgctgaaaaaaatgtacattctgttgatttggggtgaagagttctgtagatgtctattatgtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccgttatgtaatggccytctttgtctcttttgatcattgttagtttaaagtctgttttattagagactaggattgccacccctgccttttttgttttccatttgcttggtaggtcttcctccatccttttattttgagcctatgtgtgtctctgcacatgagatgggtttcctgaatacagcacactgatgggtcttgactctttatccaatttgccagtctgtgtcttttaattggagcatttagtccatttacaattaaagttaatattgttatgtgtgaatttgatcctgtcattatgatgttagctggttattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttctgaagcttagtttggctggatatgaaattctgggttgaaaattcttttctttaagaatgtcgaatattggcccccactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcttgcagagtgttttccaacttggttccattctccccgtcactttcaggtacaccaatcagacgtagatttggtcttttcacatagtcccatatttcttggaggctttgctcgtttctttttattcttttttctctaaacttcccttcccgcttcatttcattcatttcatcttccatcgctgataccctttcttccagttgatcgcattggctcctgaggcttctgcattcttcacatagttctcgagccttggttttcagctccatcagctcctttaagtacttctctgtattggttattctagttatacattcttctaaacttttttcaaagttttcaacttctttgcctttggtttgaatgtcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgtgtttttggtgtggatgtcttttctgtttgttagttttccttctaacagtcaggaccctcagctgcaggtctgttggagtacccagccgtgtgaggtgtcagtctgcccctgcttgggggtgcctcccagttaggctgctcgggggtcaggggtcagggacctacttgaggaggcagtctgcccgttctcagatctccagctgcgtgctgggagaaccactgctctcttcaaagctgtcagactgggacatttttttgtcctgcttatttctaattgagtttctttggatcttctctccttttcttcgttaatctcactaatggtctatcaatttcatttctcttttcaaagaaccagctctttgtttatcttttatattgtgttttttttgtttgtttcaatttcatttaattctgccctgatcttagttatttctttacttctgctgggtttgggtttggttgattcttgtttctctaactccttgaggtgtgaccttagattgtctatttgtactctttcagacttcatgatgtaggcatttaatactatgaactttcctcttagctctgtctttgctgtattccagaggttcagatattttgatagtttgtgtcactactatcattcakttcaaagaattttttaatttccatcttgatttcattgttgacccagtgatcattcaggagcaggttattgtacttccatttatttggcatggttttgagggttccttttgcagttggtttctaattttattctactgtggtctgtgagagtacttgataagatttttattttttaaaatgtgttgagacttgttttgtggcctatcatatatggtctatcttggagaatgtttcatgtgctgattaatgaatatatactctgcagtttttggctagaatgttctgtgaatatctgtttagtttatttgttctagggtacagtttaagtccatagtttctttgttgactttctgtcttgatgacctgtctactgctgtcagtggagtattgaagtcccccactattactgtattaacatctatctcatttttttggtctagtagtaattgttttgtaaatttgggagctccagtgttaggtgcatagatacatttaggattgtgatattttcctgctggactagtccttttatcatcatataatacccctctttgtcatttttaactgctgttgctttgaagtttgtgtgatacaagaatagctactcctgcttgcttttgttgtccatttgcatggaaagatattccattggtaacaaatatcccactggtattttgttggtaactttttaattaccatttcaatcttgctgcttgttattggcctgttcagagtttctgtttcttcctgggttaatgtaggagggttgtatatttccaggaatttatccatctcctctaggttttctagttattccattcaagatattccatccaaatggacatcaaaagcaagcaggagtagctattccacccctttacctaagtttatgtgagtctttatgtgtcaggtgggtctcttgaagatagaatatacttggttgatgaattcttatccattctgccatttcatatcttttaggtggagcatttaggccatttacattaaacattagtattgagatgtgaggtactattctattcatcgtactatttgttgcctgaataccttaggtttttttttcattgtgttaaaatgaaaaattataggtcctgtgagatttatgctttaaggatattctattttgatgattttgaggatttaagatttagagctccttttagcagttcttttagtgctggcttggtagtggcaaattcagcatttgtttgtctgaagaagactgtatctttccttcatttatgaagcttaattttgttggatacaaaattcttggctgataattgctttgtttaaggaagctaaagataggaccccaatcccttttagcttgtagggtttcggctgagaaatctgctattaatctgataggttatcttttataggttacctgatgcttttgccgcatagctcttaagagtctttcctttttcttgactttagataacctgatgactatgtgcctaggcaatgatctttttgtgatgaatttcccaggtgttctttgaacttcttgtatgtggatgtctagatctctagcagagctgaggaagttttcttcaattattccctcaaatatgttttccaaacttttagatttatcttcttcctcaggaacaccaattattcttaggtttggtcatttaacataatcccaaacttcttggaggctttgatcattttaaaaaattctttcttctttgtctttgtcagattgggctaatttgaaagccttgtctttgagctgggaagtttctttcttccatttgttcaattctattgctgagaccttccaatgcattttgcattttgcatttctctaagtgtgttcttcatttctagaagttgtgctttttgttttgtttttgtttcgttttgagatggagattcactcttgtcgcccaggctggactggaatggcgcaatcttggctacctgcaacctctgcctcctgggttcaagcgaatctcctatctcagcctcccgagtagctgggattacaggcgtctgccaccacagctggttaatttttctatttttagtagagacagggttcaccacgttgggcaggctggttttgaactcctgacctcaggtgatccacctgcctgagcctcccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttcaagcaattctgcttcagcctccccagtagctgggattataggcgcccaccaccatgcctagctaatttttgtatttttagtagagacagggttttgccacgttggccaggctggtctcgaactcctgacctcaagtgatccacctgcttcggcctcccaaagtgttggggttataggtgtgagccgctacacctggccctatatcattttttttatttctttaagttagactttacctttctctggtgcctccttgattgacttaatagttgaccttctgaattcttttttcctgcagtttagagattttgtcttggtttggatccactgttggtgagctagtgtgatcttttggggtgttaaagaaccttgttttgtcatattaccagaattgcttttctggttccttctcatttgggtagagaatgtgagggaagatctgggactcaagggctgctgttcagattcttttgtcccacaggatgctcctttgatgtggtgctctccccttttccctagggatggcatgtcttgagagccaaactgcagtgattgttatttctcttctggatctagtcacccagcagggctaccaagctctgggctggtactggggagtgtctgcaaagagtcctgagatgtgattcatcttcaggtctttcagccatggataccagcacctgctcaagtggaggtagcaggagagtgaagtggaccctgtgagggtccttggttgtatttttgttaagtgtactactggttttgtgttcgttggcctccagccaggaggtggcgctttcaagagtgcatcagctgtggtattatagggaaaatcacactgtgggcggggccatagagctcccaagagattatgtccttttttttggagttcttctgctgtcccgcagagcctacagcagcaatccatctccttctgtctgctcaattctcttggctttcctggtatattcctgcagtagttcttggagcaaaagttcacaatgtgggtttccacacgctgctctgtccatctgagtgggaactgcaaattagtcctgcctcctatctaccatcttccctccagtataccccctgctgctastatttttaaacaaaccatgccactctcttctttaaaacacctgtgagagtttgcacttgctaacacaataaagtccaggmcctttggcattttctatgttatattttccttcccagttcatgtcctgccatcctctccgaagcaccctgtgtcaatcacacctactcgcttgttcttcacacatagaggtcctctctctctccatgtatctgctcagggtatcatttcctctctttggcaccctggagtcttcatttaaatcccagactgaatataacacctcctgtgaaaccttgagggattgccctaacatttgtccctcctaccccaactctgtgatctgaaatctgtcttactacatgagttttataatactgtttacccaatttgtctctagactgtaagattctcaagaggaaggacctgtttctctttggatacccagcttgacaatgaatgcatttgttcacggaggaagatagtttgagcttaatgggaggtttagcttcagataaggttatagggaaaacaggatatttcctcttctctttatactcagaaagttcaggttccccgtgtagaaagaagaatgtagcagattgctaagctacatgaaaatgtgtttgctcacattttaaatggtgtaaaatataaattaacatcatcattagaaggctggccttaaaaagtcacatggtctctaggaagtcaataagtaaagaacagagcagcttttgtgggcaagactatactttgccaagtgaactaatagctgtatggtcaccagtgaattactttatcccagaccttgtgtgtttttgatttctcagacctcacggggatgaagggccttggttttaaagagctcggactaaatgatccaaagatttctttttgttactaaaattagttctactttaattcttaaggtctgtagaaattaaaatggaaataatttatatttgaagtagaaatacctattcactcttcatgtgctggtgtagtattggaaatcagtctgctaaaccgattcatacttcagtgatagaagatgccaccctgagttactttccccagtagccagatggaaccagtaaggaatatcatatcctaaaagaacaaatccatgtttaaagactgggaggaagatctttttgggttggagtaaggaaagttttgcaccaaggctaagcttgttgccttgtgcattctgctttgtgctcatattcgagttttgaggcaaaaacacacacctagcagtttgggacatgaggcctccatatcacctagtttttccaacccaacaaaccctcaagtttctcccgagagaaagaatataccattgtataagtttcctattgctgctgtaacaagttaccacaaacattaaaaaacatatcttacagttctggaactcaagtcctaaaatcaagctattgctggagccacattcctcttggaggctgtaggggagaatctgtttccttgcatttaccagcttgcagaggctgcctgcgttscgtcacttgtggcatcttcctccattttctagccaattgtggaggatctttaaatctctttactaaagaccctggtgattactttgtgtccacctggataatccaggataatcccccaactcaaaaatgcttcatttagtcacatctgcacagtcccttttgccatgtaaaatttataacttcaggggattaggatatggacatatctggggagctgctattcagcctaccatgactataaatatcattaacctaattaaaatggcctaaattagctggctgtggtggctcacctataatcccaggactttgggaggccaagatgggaggatcgcttgagctcaagagttcaagaccgaccagcctggtcaacagagtgagaccccatctacacacacacacacaaaaattagctgggtgtggtggcccacagctgtagtcctagctaattgggaggctaaggcaagagaatcacctgagttcaggagatggaagctgcagtgagttgtgatcaggccacttcactccaccctgggtgacagagcaagaccctatctcaaaaagaaaaaaaaagaaagcctagatagactttagtttgtattaattatagcttggctatacaatgagtcccaaattaggacatatattaaacgtccattgatttttaattactaaagcagtggttctcaaactttaatgtgtatcaaaatcacctggaaaactaaagtgatttctgggccccatccccatagcttctgactcaaaatatttagatctgggtcaaggctcaagaatttgcatttctaacagattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactcttaaagtgattgattactgtggagatgtgtgatgacagattggcacctactaargaaacctctcttgcctggtacattattaaaaataatccartggggaaataggactaatttaattacatgcctttatgcagtaagatccacagttgaaaaatagaggcagtagctttaattgcactgtaatgttcacacacaaatcatatcttgcttgaaacagttttatggcaaaaatagaccatatattgatttcacatatataacatttaacccttcaagcctttttgcccattaaatatacacacctttacaaaccaataacagtttagaagaattaagctcttctgattataaacttttacattattgatcagacagtagcacataaaattgcttttttttttagtattttacatgaataattttatttgtgcttcatgaaaactccatttatcccattttttattatactttaagttttagggtacatgtgcacaatgtgcaggtttgttacatatgtatacacgtgccgtgttggtgtgctgcacccattaactcatcatttacattaggtatatctcctaatgctatccctccccctccccccaccccacaacaggccctggtgtgtgatgttccccttcctgtgtccatgtgttctcattgttcagttcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacatttccttaatctagtctatcattgatggacatttgggttggttccaagtctttgctattatgaatagtgctgcaataaacatgtgtgcatgtgtctttatagcagcatgttttataatcctttgggtatatacccagtaatggggtggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgttagagttctttgtagattctggatattagccctttgtcagatgagtagattgcaaaaattttctcccattctgtaggttgtctgttcactctgatggtagtttcttttgctgtgcagaagctctttagtttaattagatcccatttgtcaattttggcttttgttgccattgcttttggtgttttagacatgaagtccttgcccatacctatgtcctgaaaggtattgcctaggttttcttctagggtttttacggttttaggtctaacatttaagtctttagtccatcttgaattaatttttatataaggtgtaaggaagggatccagtttcagctttctacatatggctagcaaggtttcccagcaccatttattaaatagggaatgctttccccatttgttgtttttgtcaggtttgtcaaagatcagatggttgtagatgtgtggtattatttctgagggctctgttctgttccattggtctatatctctgttttggtaccagtaccatgctgttttggttactatagccttgtagtataatttgaagtcaggtaacatgatgcctccagctttgttcttttggcttaggattgtcttggcaatgcgggcccttttttggttccatatgaactttaaagtagttttttccagttctgtgaagaaagtcattggtagcttgatgagggtggcattgaatctataaattaccttgggcactatggccattttcatgatattgattcttcctatccatgggcatggaatgttcttgcatttgtttgtgtcttcttttatttcattgagcagtggtttgtagttctccttgaagaggttcttcacatcccttgtaagttggattcctaggtattttattctctttgaagcaactgtgaatrggagttcactcatgatgtggctctctgttcgtctgtgatttgtgtataagaatgcttgtgattttttgcacattgattttgtatccagagactttgctgaagttgcttatcagcttaaggagattttgggctgagacgatggggttttttaaatatacaatcatgtcatctgcacacagggacaatttgacttcctcttttcctaattgaataccctttatttctttctcctgcctaattgccctggccagaacttccaacactgtgttgaataggagtggtgagagagggcatctttgtcttgtgccagttttcaaagggaatgcttccaggttttgcccattcagtatgatattggctgtgggtttgtcataaatagctcttattattttgagatacatcccatcaatacctaatttattgagagtttttagcatgaagggctgttgaattttmtcaaaggccttttctgcatctattgagataatcatgtggtttttgtctttggttctctttatatgctggattacatttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctttgtcaggctttggtatcaggatgatgctggcctcataaaatgagttagggaggattccctctttttctatggattggaatagtttcagaaggaatggtaccagcttcttgtacctctagtagaattcggctgtgaatccatctggtcctggactttttttggttggtaggctattaattattgcctcaatttcagatcctgttattggtctattcagagattcaacttcttcctggtttagtcttgggagagtgtatgtgtcgaggaatttatccatttcttctagattttctagtttatttgcttagagatgtttatagtattctctgatggtagcttgtatttctgtgagatcagtggtgatatccccttcatcatttttttattgcctctatttgattctcccctcttttcttctttattagtcttgctagcagtctatcaattttgttgatcttttcaaaaaacgagcccctggattcattgattttttgaagggttttttgtgtatctccttcagttgtgctctgatcttagttatttcttgccttctgctagcttttgaatgtgtttgctcttgcttctctagttcttttaattgtgatgttagggtgtcaattttacatctttcctgctttctcttatgggcatttagtgctataaatttccctctacacactgctttaaatgtgtcccagagattctggtatgttgtgtctttgttctcactggtttcaaagaacatctttatttctgccttaattttgttatatacccattagtcattcaggagaaggttgttcagtttccatgtagttgagcggttttgagtgagtttcttaatcctgagttctactttgattgcactgtggtctgagagacagtttgttataatttctgttcttttacatttgctgaggagtgctttacttccagctatgtggtcaattttggaataagggcaatgtggtgctgagaagaatgtatattctgttgatttgtggtggagagttctgtagatgtctattaggtctgcttggtgcagagctgagttcaattcctggatatccttgttaactttctgtctcgtttatctgtctaaggttgacagtggggtgttaaagtctcccattattattgtgtgggagtctaagtctctttgtaagtctctaaggacttgctttatgaatctaggtgctcctgtattgggtgcatatatgtttaggataattagctcttcttgttgaattgatccctttaccattatgtaatggccttgtctcttttgatctttgttggtttaaagtctgttttatcagagactaggattgcaacccctgccttttttttccatttgcttggtagatcttcctccatccctttgttttgagcctatgtgagtctctgcatgtgagatgggtctcctgaatacagcacactgatgggtcttgactctttatccgttttgccagtctgtgtattttaattgaagcatttagcccatttacatttaaggttaatattgttatgtgtgaacttgatcctgtcattatgatgttagctggttattttgctcattagttgatgcagtttcttcctagcattgatggtctttacattttggcatgtttttgcagtggctggtaccagtcgttcctttccatgtttactgcttctttcaggagctcttgtagagcaggcctggtggtgacaaaatctctcagcatttgcttgtctgtaaaggattttatttctccttcacttatgaagcttaatttggctggatatgaaattctgggttgaaaattcgtttaagaatgttgaatattggcccccactctcttctggcttgtagagtttctgctgagattcgccgttagtctgatggtcttccctttgtgggtaacccgacctttctctctggctgcccttaacattttttccttcatttcaactttggtgaatctgacaattatgtgtcttggagttgctcttctcgaggattatctttatggcattctctgtatttcctgaatctgaatgttggcctgccttgctaggttggggaagttctcctggataatatcctgcagagtgttttccaacttggttccattctccccatcactttcaggtacaccaatcagacataaatttggtcttttcacatagtcccatatttcttggaggctttgttcatttccttttactcttttttctctaaacttctcttcttgcttcatttcattcatttgatcttcaatcactgatacsctttcttccagttgatcgaatcggctactgaagcttgtgcattcatcacgtagttctcttgccatgtttttcagctccatcaggtcatttaaggacttctctacactgtttattctagttcgccattcatctaatcttttttcaaggtttttagcttctttgcagtgggttcaaacttcctcctttagctcagagaagtttgatcgtctgaagccttcttctctcaacttgtcaaagtcattctccatccagctttgttccgttgctggtaaggagctgcgttcctttggagggggagaggcgctctgatttttagaattttcagcttttctgctctcttttttccccatctttgtggttttatctatctctgctctttgatgatggtgacgtacagatggggttttgatgtggatgtcctttctgtttgttagttttccttctaacagtcaggaccctcagctgcaggtctgttggagcttgctggaggtccactccagaccctgtttgcctgggtatcagcagcagaggctgcagaacagcacatattgctgaacagcaaatgttgctgcctgatcgttcctctggaagcttcatctcagaggggcacctggccatgtgaggtgtcagtctgcccctactgggaggtgcctcccagttaggctactcgggggtcagggacccacttgagggggcagtctgtccgttctcagatctcaaactcctttctgggagaaccactattcacttcaaagctgtcagacagggacatttaagtctgcagaggtttctgctgccttttgttcggctatgacctgcccccagaggtggagtctacagaggcaggcaggcctccttgagctgtggtgggctccacccagttcgagcttcctggctgctttgtttacctactcaagcctcagcaatggtggatgcccctcccccagcctcgctgccatcttgcagatagatctcrgaccgctgtgctagcagtgagtgagtatctgtgggcgtgggaccctccgagccaggtgtgggatataatctcctggtgtgccgtttgctaagaccattggaaaagctcagtatttgggtgggaattacctgattttccaggtgccatctgttaccacttcccttggctaggaaagggaattccctgaccccttgcacttcccggstgaggcgatgcctcaccctgctttggcttacgctcggtgggctgcacccactgtcctgcccccactgtccgacaagccccgtgagatgaacccggtacctcagttggaaatgcagaaatcacctgtcttctgcgtcactcgygctgggagctgtagactggagctgttcctatttggctatcttggaaccgcaaacagtatgtttttcttacattttttcctttacctttttgtttgacttacaggggtttaagtattctgtattatcttgtttttattaaacctgttctagaaataaacttgttgtctctggagaatattcagttttttcaacctgtttgttggtctgaaccagtgttgcactggtattatttcagtaaaactacaaaaccttaccaaaatcctttcrggacacttaactctaagattaaattacatttcaataaatattaatcactgtaagtaacaaaatatttgtctcattcaatggtccattaatttcaagtgatttctaataaacttccaggataaaaaaatttggaccgtctcagcatatggtcacagtctgacctgtaatatctgtatcttatgaaaaatgaatacgtttatattccctgttcatttgttcagtttttctcagctgatgagcagacagaaatgaaaactagttattgaatctgtactagtctcatcaacctactaaaaaaattgaggcctgacagactcatatcctgtctaacccaggtaatcatccaaccttctgaatttctttggcaatggacatctgtttttaagagtgaatactgaagatgtttgttttaccaagtttttagagtgtgaatttaagttacacacgcacacttaaatgtcagtggtttcacatttgacaactgaaattaagtagtagtctttgtacacactttaaaaaccacctaccagttcagttaaaattgtaggtctattaacactgaaattatgtcgcttgtgtactgctatatccagtgcagctacaccacattgtcgattcagagccaagggattttacagattttaaagtgcgtttatttgacacaccacaaagtcatttaatgaaagttaaggaataatgatcaaaacatttatctagttaataagtaattttcagaaatttggaacagtacgcaagccatactatttctgaagttctacagaagttcaaacacaatgattcctttcttgtcatcygtttgtccctatttataatattaaagcataactcaaaagtatatggttactatccctttagtaacccataaaatgttggaaggtgtttagatgttctttagatttttgaaaattaagtattttttagaatacacatgggtaatgtcaacatttttggaaatatgatgtgcagacagaccttaattttacttgtatgtgacctagggataccctctatataatagcatttgccttggaactgctgctccttcagctgggtgctgaagaccttcaccttccttcttgggccatcccttacttcccatttcaagccagtaatattaaggaggacatataagtggcaacaggaaaggtaggggacagttttgccaatttgccctccttcaccccctgccccacttcagacagtttcattagcaagatccctgctcacattataaggcccattctgttccttacccatgcacagctcaagtttctgcaacaaacgctggcatacgttctgaaaagtttcccataaaacagacacttaacttcagttgctttctgagtcttggttgccactgcccgacaggagtatttattctctgatctcaccagcagggtgcagtagggagaaaagttgccctataatttcttggagtacagaacacatacagatacggtttggttctgtaccactgcttacctttcagggcccctatggtttcagtaagctttgagggcacaaactaagaaggctaacaccaagagtattgtttgcatgggtaaatattactaaaagtcaacatacaagtgaacttttagagcatattttttatttgggaactacctgaaatacccagaaaactatgccaccactttaacaatccaaggacttcaaatgttttctaaaactctctctacccaagtagacatgcaaactttgatctgaatttcctgacatttccttatttttctgtttttgttttgtttttttttgagacagagtcttgctctgtcacccaagctggagtgcagaggcgagatctcggctcactgcaacctctgcctcctgggttcaagcaattctcctgcctcagcctccctgagtagctggacacgtgccaccatgcccagctaagttttgtatttttagtagagacggggtttcaccatgttggccaggctggtctcatactcctgacatcgtgatccacccgcctcggcctcccaaagtgctgggatttacaggggtgagccaccacgaccggccttcctcatttttctataaataattttagatagtagggtaaatggagttcttatttccaggaatttgaaaagctcatattcttttgagaaatgttttcccaggcaaatttctaatgcagctattcctctacttttgaaatgtccatccctcagctcaaaagaaagcaccctgcaatttagattctttttttaaaaaattaagtttaaactggaaagggatagttttagcttgttccacatgaaatcttgctgataagcaaattcaactacatttctatccaaaagagttcctttaaaaagtctgacttacagtcaggcatggtagctcatgcctgtaatcccagcactttgggaggccgatgctggcagatcccctgaggtcaggagttcgagaccagcctggccaacatggtgaaaccccatctctactaaaaattaaaaattagccgggcgtaatggcgcacatctgtaatcccagctacttgggaggccaaggcaggagaattgcttgaacccagaaggtggaggtttcagtaagccgagatcgtgccactgcactccagcctgggtgacagaacgaaactccgtctcaaaaaagaaaaaaaaagtcttatttacaataatttcctgtttccatttctttatgcaaatctcaaataataaacctgctcttggcaagctgcagctaatctccagtttatattactgtacatagttgtatatttaaattttcttaatattgtgaacatttaacatctcaacccttctgaaatgactgatggtgaaagcttcacagaaaagctggccacgtcatgctgtcgccactcagtcccacaacaccacactctcctccctcctcctcctgtttctggctagacattgctttctggacgtttctaaggaagcacaggcccagcttctaattcgaccaaagggttttaaagtctaagttctagcattttctgaatgcttcacagtagatgttccagaagaaattaatgactacaataagcattccaaatgatattctaaaatgaggactttctggctggacacagtggctcacgcctgtaatcccagcactttgggaggccgaggcagacagatcacttgaggtcaggagttggagaccagcctggccaacatggtgaaaccccgtctccactaaaaatacaaaaattagccgggcatagtggtgcatgcctgtaatcccagctactcaggaggctgaggcaggagaatcactcgaacccaggaggcagaggttgcagtgagccgagatcatgccactgcactgtagcctgggcaatagagcaagactcygtctcaaaaataaaaaataaaatgagtactttctgtgctcaaaactaccaactaagctaaactatttcatcaaaagaccccactaatcaggaaaactgataccagagataccaaaattgatcagtggaaaacagtggtttataactctacgttttgtggaagtgcacattttgataattcttattaaaagacactaagatacatgaagcattgtgtaagtttggcagacattaatatactcatttcagaggcagtaaacctatgaacccttaatgttctagtttgctcttgaaaatgatactatttcaaagctcagtaatgtggatagatttttattcagaaatcctttcatattcactaactgcaattaaaagtttaaaattacatggctcttaggaatgacgccaaacatgcaacattttaagagtaatattaaacagtaattttgccctcagaagtttacttatcaaattattacaacaggaacacaaatagaccacatattactctttaattagatttgttttacaatatgttcttgtcaacgagctatgtcaaactgtttgtttaaacctgacagaaaagcattttcacaaaaacgtaccatggagagggagggggaggggaagaagcactttttctagagatggaaaatagttccagtaaaaagttcttattcctttcttctaaggagctcgttctgaatattttcacttagttctactgttctttaaacaggactttaaaaagaattttgtatttacaaaatttacattttgttcctacaaaatgtaattttttaattttgtaaaataaaaatgtaaaattttaattttgttcctacatgagaagtgtgcgtactttcaattagttttcattaatatcttctgagttttcctcttaggtggttggtttctgggtaaggcagagttaggctggtgcacacactatttaggaagtcctgtctcgtggctgacaacatacatgtagtgctcaaggaagtgagttaaggagtgacatgggaatcaaaatgatgcctagaatagtgtaatttgggaaacagccctagatttgacattttggaagttcactgtaagaagagaccccaaaaagaaggaaaagggaaagggttcctcagctaaatatcccactcatccatgcctactcagcggtcactgtgacaaggccatcttaatcggggccagagatgacactctccccctgtaactcagcctggctctgtctattgggatgtgcctaaatgggatgggtgagggggcactaaacagctaacactggccagggaattaaggagctaaaatgcaagtacctcttgaataccacagcaatctctgtgcacaaatttggactgtactttttgggagaagaggtgaaaactattattaactattcccttccttcaaccaaaaggaaaaatacgcctctttaaggcttcttttaatgatactataatgctgaatttatttatgaaaaagaaacaatacaggttgaggtgggaaaagccccaaggaaacggagtaagtcactggcrgtcacaggacttgaattccctggggacagtgctgtggggtcccctgctcgccatcccagcacctcagtctgagtatagataatactgcatttttgtaaagacgaaggcatcctgcatttaccatcacactccacctactcttgtcctagtcatcttacatactcttagtccttaatctctcccaaaacgcttctcagcgcccattgttattgtgtcatctacaaagcaacacatatattaaaactcagatttgtttttaacaaaaaagtgcttaaaaccaccctaggcaattgtttttcacttcattttcaaccaataaaatcaaattcatttagatctatgaataatactgaaaaaataatgcttattctcttacattttaaataatgtgccttcatcctcaactttacattaactgactcatttcagtatctaaatgaattgagctctcatttgaaaaacagaaggtacaactatatagaatttttaggataaaaaatgttctggatagaaaaatccttttgatgtttcaaaataacacagattctcagtatagttttcagtttggcaactaaaccattattaagtacccaaggtttttaaaaaataacaaaagataataacatgatttttaaatacaaagttatataggagcaactcatatctgtggatcatccttacacaaagttgtttctcactagaaaaatccctaaatatttgtcataaaataaaaactccattatcaaaaattagtttaagatagaaatctatgcactttaatgattgccagaattgcccagcatagcttcagtaaaatagagaattgtctagaaaatacaatctccaaaatgtgtgcaagtactgcaaaccggacagaccggggcagggcaaggcccttgaaaccaagtcctccttgagcacctttcccaggttagaaacccctcttcagcctgtgcttcgcacgtttccttcagcgtgccgccattcagactgcgccacttacgtcccagtgccacgctgcgtggatcaagtgtcaacrggaaagtatgagttaggcaagcgctttttttttaagctgtaawcgcttcacatgactggccccgtaagaaattgtgggagcttagatgagcctggagcttttcaggaactggatgaggactctgtacacaaatgtgtactggcagagagtctgcaccagcatcattctctgttgcctcagcatgtccagcactctcgggatgtccagcacctaggttgagagaaacggtaatgaagataatgtgttcccctrgggagacagaaaggatgggaggacacgagtgtcctggcagaaacctggttrggagatggacagtctcttttccaccttagcgtcttctagaaataagccatgattgcctacttctgattttctgattagttttagctataaatagaatgtccatgcagactatttcttcaacattccccaggtgtagctcactgactttgtatgrttggacataattaccatgtctcactaaataccaaaattatacaaaaacatagtgtgctaagtgctatcagtatctagctatttccctcaagggctctgggcagcatgaatcatccttgaaatgtaaacagaaaaagaattctgagctcaaatttgaaaaaccctgggcaagtaaaacaaaattaaacagctttatttatcgtatgacttcttagtctttaatatgctaattggtactgagactctccaagaagacacagccttttgcagggaacattagtaacatcttgaggccaccacagtccaaggaaatgtgcgcaaaaagagctattaagtcactatgtccytctcttccccagcctyatttccacccaaaaaggccaggtgatcataagcgccatcacctcattgtgttccaggcaggcratcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatcaaggcgtatcacattgttgactcaatcttcatattctctccactgattaagaggactgcagataaagagcactgggtgccagtgaaccaaacccaaccacaaagggacagtgtgaccctgagcaagtcactacctctgtccactttctgatctacaaaatgaaatgacggagatactgagtcagctgtggcrttctactcactaccaaatcataatttataaacctcgttaaccctccccaaaacacttgtattctttatgttaaaacaagtccgaagcttatatgagataacataaaggaaatatttcggaaacataaatgttcctctctgtttaacacctccagaggcagctgtcctcggaacaaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgtgcctggaaccaagtcgtggccagtacctaaagctcttctcccttccaccctcctgttaaagatgagcatggttaaatgactcgagatccggcaatggatgcctttctcacatagacggcacatctgaaacagaaccacaaccctaccctgcctttttctccacaggtcaggattccagatgattaacattaactgttcttcagaggctgagaaaatcacttaagagaartaagtacctacctcttctgctgtcaccattgctataattgcaattccctgttcccataccatctgccaaaaatcttgacaggtattctgtaatggtccctgtgtggcaatataatcccattcgattccactgacagagacctgggattagaaaaggttaaaaaaattgatgtgtgggtataatatacataggtatgtatgcatgcattcatggtagtactaaaaaagtttttttaaaaaagtaaaaagtaaaaaagtagtaaactggattattcagcagaataaggaaagacttttcatcttttcccttgtgaatacaatttgcattactgacatttttataaacttaggtactgtgaatatacataatatctatgcaacctgtttaaccttgctgaatgtcagttctcatttatacaataaagatactgcctaccgtcatagggtcattgtgaggactgagtcagtatctatggtacctggcacataactcaataagtagctgttattgcagacatggtgcctcttctttaaaaaaaaccttcctacttaagatagtctcacctctgaacttctgagtcaaggtcactctccacaataatattaagtttccacttcagatttaacttccttgagagcagtctaatacaacagtaattactagatttgtggttaagagacctgggttaaatcttggcttcaccaatattgagtgacgacaataactgtctccaaacactcactaaacgtaaaacccagtgccaagccttgtgccacacgcactctcactcagggctgccagccccctagtcaccgctccacatcgtctcactgagcacccagtggctgccactgtggatgagtaccaggttataacagtgaataaacactagggaggaggaggggactagtgagaagctggcagggtaggtgtcatcatttatttatttccatgtaagtgagatgaggtcccacaacacagcttataaagtgaggtcccacctcattttagatctaggcgtcagacccaggtctatcaaattctttcctctattctgcaagtggctgctgaagattttgaaatatcactacagaactacagtatcattcattcttatccatctagtcatgagagactggatgagttatttcaaggaaatgctcggtttttaagtaaattatgctgatattatatttaaaaacaaaatagtatgtgcatagattcccaaaagccatcaaggggtactggcattcacaggcagactgccagtctccagaaagccttggtgtcagcttgttcccttctcaaataatacttgcaaactaaagaaaaaaaccaccacctgtccacagttactcattcactcaccatgagatttctccttcccaaaataaagaattgaatgtggccagcatgaacaaagggtacaatgaggaagagggaacatctggctttattccatcatgtgttgtgaatcatcattttgtccattttcataggagtgatattaccccagataaggtgccaagaacatacactagggaaggacagcctcttaaatacatgggactgggaagactggatatccataagcagaaaagtaaaactggaccccctatctctcaccataaacattaccccagtttaatggcattatactggttccaggaaaaaagcacttcttcaaagaaaaaaatgatacttaaaaattattataaagagtatgtaaagagaacagatggcaccttggtaagttgaaagcttttgtgaacaccatcaaaaagcccagacacttttgttacataaaaatgcatgtcagtatgtgatgaggaaaaactagcaattcagtggctcccagaatttatgagctaaaaagaggtcttcagatttagaaggacaaagttctaaagccaggcaacasaaggtcaaggctgtagggagccatgatcataccactgcactccaccwgtctgggcgacagagcaagactctatctcaaaaaaggcaaaagaaaaaaaaaaaagccgggcaaataagtgcgccctgagtcctggtaacagtgttgggggcagagtggtttcgcacatggagagtagacatgactttggctctgtctgatagacrctttttatctagcactggtrtgtggatttcccagcttgcagtacagtttgtcacaaatgtttaaaactagggtgtttatctaaaacaatacaataaaaataaattttaaaatatctgaattctaaacagacatgaatacaattcttaccattcttgtaacttaactgaaactgcatgtgctgttgattacttgaggcgttcctctcaccttaatatgtgatgcrttgatgtaaccagtgttgttttctttagttgggaccaactccactctcrcatcatcataaggaagaacatcttggaatcgatttctttctgcattttcagggagtcgtgctgttgagcactccccatcaactagccgkttyttaagaattctttcatattctgkgaataccattccttgttctaatcgttgttccagaattttacactataaaacagaatatgtgtaataacatgaatacagccacacgtcgtggctaccttttgactgtatatttgaaatcttgttttctgcttcaaatctagcactgtataatattgaaaattctaggttgggcacggtgtctcatgcctgtaatccctgcactttgggaggccaaggagggaggatcacttgagcctaggagttcaggaccagcctgagaaacacagtgagaccccgtctctgcaaaaaattaaaaaacgagccaggtgtggtrgtgcatgcctgtggtcccatctacttgggaggatgaggcaggaggattgcttgagcccaggaggttgaggctgcagtgaaccrtgagaacctatctcaaaaaaaccaaaccaaaaccaaaacagaaacaaaattctaggtgaaaatgaagttaaaattttaaaaagccacaacaacaagagttaaaagaacaaaagacaatcattttggtgagaaatataatgcaaacttttgtttaaagttgaaaattggcctaaagaaatttgttgaattcattttctctagatctgtggtcaattttgtgacccctaatagatggaattctcctggggaacagtaagtaaatctaggggayggataatgagttccaacagctatgaacaaatgtttccattttatgtcatacgatatataaaagactaaagcagtaggaaatattcgaaactacctccaggatcccgttgtaaagcaaatgtatgcctatctgattttgatgtaataaaacctcatagaaaatacacctcaggcacaaaggaagttttgaaaaattgagaaactactctcgagataaactttcagtataataaaagtcaatgtctgctgcttttcccctgtatgctcctgtatttttgtagatttcttctcactttaaggccatcaaaatcaagactgctccaaaaggccaggagaaggtaaaaaagaacactgagaaacaaacaaacaaaaaatcagcattcgaacctgaaattatctattaagacattagctatacatttgccccaattttgaggcccatattacaaaattccttaacactcatttattattaaattgtgttagaaaattcaccaaaatctcatgaaggcatttgcgtagtatttaccggttgttccagagaaggcacaaagccctgtgtgtcccatacataccctttcatcattcgttgctctggtagccacttcctttccttcatcaggcagaggcactcgagatagggagagtccatttagggcagccagtttaagaggaccaattttttttgcatctactcgagtctttttcattccctgtaaaaggatttatatgtatatatgaaatatacacaaatacaacccctgtgaaaagaagtttcaatgcactgaagaccaggaacacacagagggagtgttctcctttgccaataaacccagaaagattacactccttcacacamcacttgtttaacaaacatkagtaggaagacattcctttcaaggccaaagccctgataaagtcttccagatagaaggttttgaaacactattggttacaaagttctgttgtaatgaaaggtgaggctccaggcagactgcattccttttaaaacaagacagacgtaacaaatcagctgaagtccaaaaaaaaaaaaaaaaaaaaaaaacaaaagctttaaatgcaatcaattgactatagtaagcttttataaattttttttttgagggtctcactctgtcacccaggctggatggaatgcaggggcaccatcatagctcactgcagcctcaacctccagtctcaagcaatcccacctgaacctcccgagtacctgggactaccagcacatgccaccatgcccaactaatctttgtgtgttttgtagagatggggtctcactatgttgcccaggctggtctcaaacaactgaacttaagcagtgttggcctcccaaagtgcttgagattacaggcgtgtgccaccatgcccggacagctttttataatttttaaaatatataaattctttaagtcattctgaaaaattaaatggtttctgcagcagccccctttgtgtgttaagccccctcctcatatgctactctgcattctagtgcagacttagatgacccgggttagatcacgctacctctcagaacggctacgtttttaaacaaggaaaataaaacagggctaaaatctccatcatgacaccaggaggataggacagaagagaaagcatcaacaaaatcttgtctcctgaaatcaagtgtttcctaaaattattattagagcatgattttcctctctgagaatagtaagcataagaacactaagttgaccaggtgcgggggatcacgcctgtaatcctagcactttgggaggccgaggtcaggagattgagaccatcctggccaatatggtgaaaccccgtctctactaaaaatacaaaaattagctgggcgtggtggcacatgcctgtaatcccagctactcgggaggctgaggcaggagaaaggcttgaacctgggaggtggagattacagtgagctgagatcgtgccactgcactccagcctggaggcagagtgagactccgtctccaaaaaaaaaaagaacactaagtttcgttggatatactacacttccttggatgatatcaatataatgagtagccccaactggaaaataatggttctgccctgtaaacaaaatccgtgttattccagctctctcagcctgtaacaggccatgaagccccatgataatggtgcaagaacagagggaaaaggcaacttggtgagagaggaaaaaaatcctaaaagattgctgctgtaattggagactgtgattggtacctaactcaataagctaagtggattaatttttaattttataattaatatttgatcatgagctccccacataatgcagtctagactataaacagcagaggcctgggttcacatctggcctctaactgaccaacttctttcaggcaagtcacctttcctctgtaagcctcacctagacagaaagagacagatatatccagacacaggcatacagactaaacacttcctgcttaggctgaaatttaatgattctaacgtgcagaaaacagtgatgtgctggtaatatttaacaacwggctcttggaaggaagttttgatcggtgtttgcccatatccatggtgtaaatactcccatcacagccaatttcaaactgttaatgtcacatcaattggctcacaagrttcctgaacatttaagtcggctcttgctagtcaatatgaactagctctggcacttctctgcctgaaaatgactcaaaatatcccacactgggacacgctggataaagctgattggctgtgaggtcagttcaaaagccagtattggaagaatgttgtatgtagtcaaaactagccttgaatatgccttaattagcccttagaatataagcacaggattttaatgcataccctgcacagtgatttcttatgtgagaaccactgcactaaagggtacaacaaaaagaaaatctttatgtagatatatgagcacccaaaccagtctgcctttaagataacaatcaggttgctggaggtggagatgggtggagaattctaaaatcattcctacttgtctacagtttatttcactgtttttaatactaaacctccataaccttaattcacattaggaaatttgttgtaacgattaagataatggcaaccccatgttactatgaaaggtcagagggtacaatagggaattggcctcttccactcttgaaagccattaagttaaatatatgatgccacctcacagtaatgttaatattgactaatctctttcaatgt

SEQ ID NO: 13290 - DNA, 18310 bp, Homo sapiens
acctgggaaggcctcgttgggggtgaaaccagagcccaccagaaggagcaggacggaggcagggggttccccgggagggcatcctggcaggcactgttggaaaggcagcaggtagccatataacctcaccaacaaaatgcctgcatgccaggcagtgcacagagggcttaccacattgaccccattttaaccctcagagcgaccctttgaggtagcactactactctcactattttattttttgagacagggtcccactctgtcacccacactggagtacagtggcgcaatcatagctcaccacagccttgaactcctgggctcaagtgatcctcccggctcctctgcctcctgagtagctgggagtaaacgtgtgagctaccatgctttgctaattattattaattttaaaaatttktatttatttattttttgagacagagccccgctcttgttgcccaggctggagtgcagtggtgcaatctcggctcactacaacctctgcctcccaggttcaagcaattctcttgcctcagcctccctagctgggattacaggcatgccgggctaattttgtatttttagtagagactgaatgtcaccatggtcaggctggtctcaaactcctgacctcaagtgatccacccacctcagtctcccaaagtgctgggattacaggtgtgagccaccgcaccaggtttttattatattattttgttgagacacagtctcactctgtcgcccaggctggagtgcagtggcatgatctcagctcactgcaatctctgcctcccaggttcaagcgattctcatgcctcagtctcctcggtagctgggattacaggcacctgccaccgcgcccggctaatttatgtattttttttagtagacacagggtttcaccacgttggccagctggtctcaaactcctgacctcaggtgatccacctgcctcggcctcccaaagtgctgggattacaggtgtgagccaccgcacccgaccctggctagttattttcaatttttgtagagatggggtcttactatgttgtccaggctggtcttgaactcctggcctcaaataattctcctgccttggcctccaaaagtgctgggattacaggcatgagctaccccgtccggcctctccctgagtaacctcagtcactggtttcacgctcacagtattagcgtacccagtcgttgacgccaggcatagtgtctgcactcatcgctgcagtcctggcatacagcaagggctcaacagaacgaacgcagtggagctgggagaatacctgaggtctgagaggaacctaagaagtccccgcccctcctctatcacatgacagttaggtaaagtgaggcccggagagagaggcttcagcggctcacccagcccccgtgggcctggatccagggcgtgaagctgtgcacgtgctccacgctgagtccggccagggtgccccccagcccggccacgcgccggctcagctccatggctagggccaggcgggccaggggctccggggaaggaggcgggggcccggggcatgctcggcttgggcgagagctgtcatcccggctacagaacagctccaccaggcgggcgaaagagtcggaggacagkcggaccagcttgctgcgcagggcggggtccgaggccagctgtagggtggaagaggcagggtccgcgtcagcagcgcccccggggccagccaatagagggccgggaggcgtggcttcccggttcaggatcgttctagatgctaaggttctaggccacccctcatccatattagccaatcaagccagactccagggtctctgccaaactacccccgggatastggcctggaacgtgagtccctaagccatgccaggcccttgcctcaacagccaatcagggccaatctctactgtaactgagttaatctagccatgcccctggtgacctttcccaggggccaacctagtgtctacaacaatcttgccctctaccattcaattaatattaaaggacgatgtaccttgtccaagctccgaagccaatcagattccaggacacagccacaagccacacctcctctggtagtacattttcccctacattctaagccaggtcccttctatgctcagtaagattttagccactccccccacccccacattcattcacttacttccccagcttggccagtctcttgtggataatgtttctgatggccacaccctctgcatttaggccatgcccctctaaacaatcaattaaaacaactaatttacggtacagtactaccctaaccatacccctgtcattcaactattcttttttttttttttttttaaagacagagtctcactctgtcacccaggctggagtgcagtggcgcaatcttggctcactgcaacctccacctcctgggctcaagcgattctcctgcctcagccttctgagtagctgggattacagaagcgcaccaccacacctgtccgatttttktwtttttagtagagatggggtttcaccatgttggccaggctggtctcgaactcctgacctcaagtcatccacccaactcggcctcccaaagtgctgggattacaggcgtgagccaccacacccggcctcaacccttcattgaaaccttgtcccagcctctttccacctgaccatccaaagaaaatacagatccagcttctgatcccagtgccccaccattccgcaactcctgtccttgccaaggagtgggacagatgcccatcaccttctggttaatgacttctgcctcctcctccagcagggccaccagcctccgcagtatggcttccttctctgtcgatgggggaccctgtaattctggaggcagaagagaatttggctgggggcagaaccctgactatcctcccaccgccatccttctctggggctcctctgtgcctcacctgggctgggcggagatttcagctgctcttggaccagctgttccagccgctgggccaccaaagcatagaagtctggagtagctgggcctggggtgaaaagagttaatgacaggtttccaggacattggaaacttacggattctctccttcccccaactaccttggcaggtggcaatgattcccattttatttattatttatttatgtattgattttgggaaacggagtctcgcaattctcctgcctcrgcctcatgagtagctgggactacaggcgcacgccgccatacctggctaattttttgtattttagtagaaatggggtttcaccgkgtkgcccakgctgacctcaggcaatccacccacctcagcctcccaaagtgctaggattacaggcgtgagcaaccaagcctggccatgattcccattttataatggggtaaactgaggcccagtgagaaaacttggttaaaaatgccaaaacccttgtacttttcactttatgagatcctcakactggacttagaatgtcagagctggggccaggcgcagtggctcacgcctgtaatcccatcactttgggaggctgaggcaggcagatcacctgaggttgggagttcgagagcagcctgaccaacatggagaaaccccatctctactaaaaatacaaaaaaaattagccgggcatggtggcgcatgcctataatcccagctacttgggaggctgaggcaggagaattacttgaacccgggaggtagaggttgtggtgagccgagatcgggccattgcactccagcctgggcaacaagggcgaaactccgtctcaaaaaaaaaaaaaaaaaaaagaatgtcagagctgacagggtgcggtggctcacgtctgcaatctcaacattttgggaggccgacgtgggagggtcacttgaggccaggagtttgaggccagcctggccaacgtggcgaaaccccgtgtctactaaaagtataaaaatcagctagtatgctggcgtgcacctgtaatcccagtcactcgggaggctgaggcacgagaatcgcttgaacccaggaggtggggattgcagtgagtcgagattgcacccctgcactccagcctgggtgacagagcaacaatctgtctccaaaagactgtcagagctcaactagaccttgaagatgatctcatccaaggaaggcaaacacaagacattactgttagtatccccttccctcactcactacagacatcaccaattgatcacagcacttcctctcccaagctgtgaaccccttttcaagytagcactcccagcagccattactagtctgtccaggttcacacctatgaggaaacttgtgggtcaccttgatcaagtccagtgacctcctccccaattcctactctgctattggaaaaacaggggagcagggaagagaaagcattttccccagagtcacgcaactaaaacagccagggagatgtgattgaaaaccagcccttctgcccctctatcaggggtattcctggctacaaaagtcctaggggcagggaagtagttatggaaggaaagagacaacaaccagattgaccaaatgctctctgaaagccaacccacagaattgacagaaatctaactggggaggggagaggacaggacggttctgtcctgaaggctggtgctagagactccacacagccaccccctagctgagtgatcttaaactagcaccttatcccgtgttctgccggcttcatagatgatcatggaaatctcttaccaggctctaaaccatagcaggggcggatgggcagagagcaaggccgaggggactcagagggggctgctcctcgccccagggagcagggaagacatcttcgaaggcggctcaggaagtctgttggctcttcttgggcagrgcttctggagaggaggacttcagagactgaccccaccagagatcccctgcaagcagtctctttccccaactccctccctcccscgctgaggacctctctccaaaaccccaaagacagagaatagagccagatataaagagaggagacagactgagaccaggagcaagagttaggagggagcctcaaatgctggcccctgggggagaagggccactcctcttacctaggtggagttggaacaggagacccggcagcctcaccacgcctaaggaaggcagctaggaccctcagcgtgtcttcccggagccccagctcttcagagcctgccatggaggcacctgtgagagagagggttagggactggactccaagggtttagcaagaagtggaggcttggggaccaggacttgtgagtcccaaggaaggtgctgagggcctggactcctgggtcctttggagagtgtgggtctgggggcctagactcttgagtcctcagacgaaaaagcgatcaggaaaaagactcttcgatccaaggaaaggtggtggggctgggtgcccagattcgtgggtctaaaggaggagggagctggggtcctggacttctgagtcttagagaaaaaggaactggagccccagacccttaggtctcccaggaagaagaggcttagcgccccaactcctggattctataagaggcatatgccaaactcctgaaacccttaaagcatcgggaactaccaatcccaagaggtttcagggcaaatcttcccctaggtccgcgcttcttcgccgcgcagcctgctgtgaggtgtagttccaaatctccgacccctgctggaatctagaggaccctggacccttggatatcagagaagcgggactggggtgcccaccactggatcccggccccctcctcttccctcctcaccccacccctcgtcaacaccccgctgacctggtccggggccccaccgccgcctcctccactcaacttgcggtctcctccactgaactcgtacaaactttattagttcaactttcccgcgcctgcgcactgggmcgggtcgataaccggcccagcgtagaaagggcggaacgctgggtgcacgctcaatttgcatgtgacgctcccagcatgcctctggccggaaacccaaaaaagggcataggggcgggaacagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagcyccaagacaggggkgggttccagctgcccgcacgccccgaccttccatcgtaggtaacgcggaagagccygggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgrgtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgatggtggggcgcaagcagggttggagctgcaggsttacgggaataaaaccgggaaagccggttagtacgcaaaggaaatgcatcctgggggtttggggctttctagaggccggggctcttggttgtaggatagatactgggggatggttcttgaaacatcagaggtgaggcctggagccccaaatctgaggttcctaactaccgaattagtatatgccagaggtggtaaacagtgtgaggggcggggttatcacagagggtgtcgcggggcaggtggtgcacgggattagacaccaagttggacttggaagcctggcttagaaagaaaaggtttttgggccgggggcggtggttcacacctgtaatcctagcactttgcaaggccaaggcgggaggatcgcttgagcccaggagtttgaggccagcttgggcaacataggctccatctctttaaaaacaaaagcgaaacaaaacaaaaaccaaagaggtttcaaaggcttttgaagaggccgagcacagtagctcatgcctgtaatcccagcactttgggaggccgaggaggacggatcacctgaggtcaggagttcaagaccagcctggccaacatggtgaaaccccatctctactaaaaatacaaaaattagccaggtgtagtggtgcccacctgtaatcccagctactcaggaggctgagacaggagaatcgcttgaaccggggaggcggaagttgcagtgagctgagattgcaccattgcattccagcctgggtgacaggagtgaaactccatctcaaaaagaaaaaaagccttttgaaaactagaggtgggggatggaggtaggtgggacggggggatttggggatggaccttgcagagttagaacttgccagggaaagagggtggtgttaggactcgggagacagggttagggccccaggagcaggatctaagtcgtcctcccccaccrtcctgacaccactgttgccccaggcctgggccgaggccactggtgcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggtctgccagcttggggttcgtgtgggaggctggggccccaagggttcctggcactcctactcccctcaccacttttctcaacaggagttggggacttttcccagccagacacctctccggacaccaatggtggaggyagtacttctgatacccaggtgagaatgtgcccaactttcatgcccctcagtctccgacctgtctccatgggccttgtcctctccctctagacgatccccccactcccctgcctccagcctgcccctcacctgagccagtgctgaccctgtctgtccctgccccggtctcctcaggagaaaattccaagtcttcacccagcattcaaggcccgagcacaccttcccgggatttcatggatttcgattcgcagggggctgtcagcctcttgggaactgaaaaactccctcaccttgatcctgctgaggcccaagctgggggagcatcccctctgaaattctacccagcctgctttgcccaggtcttacctgcatagagccagatccttgggttggaatggtagcacctggcgttcattagtgtttgtttggctgttgatgccatggctggctctgtccccaggctggaagccccttgaaggcagagctcaagcctgacctccctgcgttgctgagaacagacctggtccatatgaagtctccagaaaaggatatggaaatgcctgattctctttttttgtttccctccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaaggtgagtgtcagctgcaggctgggagggctgaggtctgggcggcagcccctgattctcaacccctctccccttcatgccgctgctgccgctgctcagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggygtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctggggtgagacacaggcccagtacacagagcctgctcagggaattagctgccactgtcatcatcatcgtaactaatgatggtgaacagaccaatagcaggaaagctacatcccttagggtttcgctgtgcagtggcactttytgccatgatggaaatgacagtcacctgcactgtccggtgcagcagccactagccacaggggccaagcactcaggtgaggcgagtgcaaccaggacgtgattcgttttaattggttacaatttaaactgaaataaccttacatgactaatggctgcaattggacaatgcagcctcagacrggactgaatgccaaccagcttctccagattcactgagcatccttgggagcatgggccccctactctgggcctgttatgaatgctgaggcttgggggcttgggggtgtggccttccaacaaccccaccctgatgggagggagggagggagggaaggaggggactttccccaaacaagcagtcccctggtcgaggcagcagagggccttaggtcaggggaggtggtgggggttatcattcaagtttacggggaagggtgggtagagggtcctcttctcatccctgactaggctcctgggcccccagatctgattaccttcacggaaggaagcggacgctcaccacgctatgccctctggttctgtgtgggggagtcatggccccaggaccagccgtggaccaagaggctcgtgatggtcaaggtgcctgcagacctgagtccctggggctgaaaggggtggccttacagagggaagaggttgctcccaggaactccaactcccagagggccctctaaaaaactgcaacttccaagatctctgcaataaccagtttttcatccccgggagctccttcccatggcctcacctgcagaacctgttttgaactctctaaaccagtggcccccaaactatttggcaccagggaccagtctcatggaagataatatttccacggacagggaggtgtggtttcgggatgaaactgctccactgcagatcatcaggcattagattctcttaaggagcagccgatccctcacgtgcgcagttcgatagagtttgtgctcctctgagaatctaatgctgccgctgatctcacagaaggcagagctcaggcagtaatattcccccacccgctgctcacatcctgctgtgcaacctggtccctaacaagccgtaggggggttggggacccctgctctaaaccatgtagaagctggtggactcaagttttagctgccattgtgaggccatggctgtggctcccaggagtcaagatcacagactgctcagccctgacgtgtgtgtgtgtgtgtgtttgtgtgtgtgtgtaaaactacaactcccagcagccctaggcctatggttcagttacagcagggggtgtgtgtgtgtgtgtgtgtgtgtgtgtgtgtgtgtgtgtgtgtgtaaaactacaactcccagcagccctaggcctatggttcatcctaggttacagcaggggctgcagggagttgtagtcctccaagccctgactcctaccttggtggacagtggctgggtgttttccctgactcctgtccccacttcccctgcaggttgtgcccacgtgcctcagggccttggtaraaatggcccgggtagggggtgcctcctccctggagaatactgtggacctgcacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgctatgatcacttgtgcgtgtctggtgttgggtgccctctgacccaatatggttgttattcccgctcagggtctcagtttacccatctgtgcagctatatacaactcaggtgctcaatgcatgaagaccaagcactgcagggggcagctgacacctcctcacttctgcccagggacctggtgggtgatggctgtccccgtgttgtagaccaagacacaggctgggagaggcgcaaaggtcacagagtaggaaacacaaagactagccagaacccaggccccctgccttgcctatgaacagtttgggcaagtggtccttctccttccaggcctcaggctcccctccacgtggggctggaggggtcttggtaaaggggctctgcggccaccctggagcctgcaaagcctgcctgcctggtgaccctgggcactgtcacctctcctggttgggccgcagttctgggtgatgaaactggcagaagccagcgcagccctgactcacccttcggcccttgctgctctgtgcctcagtttccctctcaggacagttgatgagatcaccccagcttcacggggctgctgaaaagagaagccaactcaatggggaacacagatmctgctctgggagcaattccaaggcaggcacatggcacccaggagccgagctgggaagatgctgatcaggtggggtccggcccctgcctccctgtgagcagctcgctcccagccagagactgtgctaagtgctccacctgtgtcttgttcaatcatcacaacacccactacacagataagaaaactgaggcccaggggaggcagctgccccaagtcacagtctggtctctgtctcccatcctcagcctcctgggggtccctccccaaccctctggcaaatttgtctccgaaaacaaagggttagaaccatggggctcaggggtaatgtttcatgaaatctttaatgaaattggggagaggggcacaaacagaagggaggggcactggggacaggcttgggggcaagggaggtggrcacggggcagggcagggcagggggctctcctcttccctgcagcaaccctcccccagtcatcccactgacgggggagggaggtggggaggtggagccataaatacgtccagagtttcaaagaggtgaggggcgaagagctggccagggctctcagagagggggcaggggcaggcccgggccacccttgtctgggggccctggctccttgggcggccgtgggggccctggggggtcccctggcttgcgaccgtgcttgcggaagtagcggtagcgctggacgtaggcccgcaccaggttgctcaccttcactgggttgatttccccacttttgctgtggcagatctggggggccggggacagttggagtcaccaccaggctcccggggccccatccacccaggactgttgggcgcagcttggaactgcggtaggaggagcttccccaataaccaggccaaagtccctctgtccccctagacgatgggtgccccagggccagcggaacaggcccaggtggccttgagaaaatcctgtcaccctcmtcacctcccagactgacctcctccccgtctcccatccgcgtccatctgtctgcacacatctgtccctccagctcgttctctccccggcctgtgtctgcccctctctccgggtgcccaccttgtggacggccttcctcaggatgtccttgtactcctccttggtgatgtccttcytctgatagtatggcttgatggccagcttcacctcctccaccgcccgctcctgcgtgtgcagcttcttcagatactggtggggtggcgacagcgggggaagacacagcaagggccagtgagtacctgcggaacctccacctccactcgcctctgctgccagcctaacctctctggccgtccagctgctctcaggctggaagtcctgctgagggtctgtcccatgcgccctctgctgcaggtgcccgggaccaaaggccaggcctgggcctctgcatgtcactgaacatctcctccaggccgaaccctgggctgctccaggcctggccgggaccaggacatgtgtgtcgcctgccctcacaaagttcagtctgatgagaagacaggcattggccaagaaattgcagctggttttgaatcagactctagaggcggggctgtagaaaactgcacagggcttttcaccgcgggagcggggaggactcagtttaggtttttacagtactgctctggtcacccaggggatggagggggtggctaggggtgaggggcactggggagtgggggtggggactgaccttgagcccatttgtatcagaagcctggtctgccactccctgtctctgacccctgggatgctcagccaaacctttttgtggctccttttttgtttctttgtttttgagacagggtctctcattgtcatgcaggctggagtgcagtggcacaatcactgctcactgtacccctggtctcctgggctaaagcgatcttcccacctcagcctcctgaatagctgggactagatgtgccacccccacgcctggctaattcttgtactttttgtggcgactaggtctcactatgttgcccaagctgatcttgaactcctgggctcaagcgattcacccgcctcggccttgcgaagtgttggaattacaggcatgagccaccgtgcctggccacctttgtggctcatttgtaaaacggggacagcacctatgggcagtactacagcgacacacatggaggacatggcacaggctgggtacagagcaaagactcaatccaggggagctgtgcctgttccaagggggatggccatgggatgaaaaggggaggacgcaacagggacagggcagagagcctccgaggcaaggctcttcccgcctgtggccagcaagctaggagatcccgcagccgcaggctcggggcagcagctgcagccctggcctcaggcagaatccttgcaaaagcagacaggaaacctctagccagagagccacgtgggaccagagaagaacaggccttctgcaggcacaagggacagtcccttggcaccacccttggagaagctgccctcccaagccaggtgactatcaaagtaggggcaggtaaactgagtcctgggaagggcagggcacaatggctagccgactccaggagcaacatcagtgacactgtctgacgagctactgagctgttagggaactctgtggccagaagagacacaggctgccctggagggacttctcaggcttgcctggccccacaggatgtgggtctctagagagacgctgctccccaacacccatctcggatgggcaaagcggggcaaagggcagagcacagaccagggcagagcaagggccactgtagaccagggggtcctcaccgtcygagtcctgcagcgcaaggcacaagctacggacaagtgaccgactaaactgcagccccgcctctgcggctcacacaggatgtttaatggggtttatacagctttatctggcacggtacacagctgtgtaagggtggccaacgtcaccgtctggctatgggctactagactgtaagaaaacacatctaggctgggtgcagtggctcatgcctataatcccagcactttgggaggctgaggtgggagaatcacttgagctcaggaatttgagaccagcctgggcaacatagtgagaccccaactctacaaaaaattaagaaatgagctgggcatggtggcgcgtgcctgtagtcctagctacacaggatgctgacgtaggaggatcccttgagcccgagagatcaaggctgaggctacagtgagctgtgactgtgccactgcatgccagcttgggtgacaaagcgagaccctgtctcaaaaaccaaccaaccaaggccgggcayggtggctcacacctgtaatccctgcactttgggaggccgaggctggcagatcacctgaggtcaggagtcaagaccagcctggccaacgtggtgaaatgccgtctctactaaaaatacaaaaattagctgggtgtggtggcgggtgcctgtcatcccagctactcgggaggctgaggtaggagaatcacttgaaccctggaggcggaggctgcagtgagccgagatggcaccattgcactccagaccaggtgacagagcaagactccatctcaaagaaaaacaaaaacaaaaacccacatctagacctgaccaagagagaaacagctccagagcccaggagtaggagccggccagagcagctgagtaagaacctacattactgtctgcctggcacccattctcccctgcttcatctacaaacaggttcttgagttttcattcggaaaccaccctcccccactcacagagacggagacagcgcgagcaacagataatcaaggggtgggctgcagcgcggggcatctcttccagggtgtgtatatgtggtgtgtacgcacacagccccacacacgcacagacgcgattttcctttggacacgcctaacgcatttcctgctcacccattccagcaaagtggagttccttatggttccatgactttggtctctacggccctgtctccctgcctcagtctccctttctccttgggcccccgcgtctcagttcctgtccatattctctacagaactgtcagcaccgccccacctctccccaggccagctcaccttatctgtgtccccacggccctcagagctgctgctgccctctctcttgtcagacgtggcagccagcccggtgggggtggggggggtcgaaccgcasccccccagagggaggctgccaggaagcaggtagctggaggggccagggggyagacccaaagaggtgggcacaggagctggggtcrtccccagacttgagggtggctttctgtggctgaggatctgtgggacgaggacagaggggtgatgagtaaagggaggtggaggggaagaggggacgtgcaccccactgttcccacgctgacttccccacagctgaggcaacaggctcctcttcaggccgataccttgccccagagctgccaggcccgcggttcctctcctaacccgaggcaatggacaaaagaaggggcggcagggactctcccccaggggagcccacctggttggtggcctggatcagctcctgggccttcgctcggctcgccaggttggcttcttccatcttgaagagaagtgcagtcactgcaggaggcagagaggtgacaacatgaagatgggagaggtgacaggacaggagctggtgaacctcacctggacacctgctgtcatctcctgcccttggccccagaacagccacaaagcctcacgctcagaactgggaaaagggggccttggccaatgagagaacagcccataccacgaatgttcttgggactccaggtgtgtgggtgcggggttggccagggtcatgcagtgatgagacagtggcaggagtgagattctgcctcctgacccgctgtggccagtcccaacctctctccccacctctgcagtctggtagaggcaaccgccatccgtaaggaatacgatgccctgctcaagccattctttctggtccctctctcctactccccgtctaggggaatcccagaacccagcccaccactccagtctgtgctggccaccacctgctctcaccggcccctctctcccagtacacccaggcacctagagcctggctggcctttactcacccccaccctcccagtctatgtccctataaacctctccctgccagggcaccccactgcctctaagtctgtaccctccagtccccatcctgtctcacctgccccagcaccaccctcccccaggggacactcacaggccaggacgccgctggtggtgcagtccacaccagctggcagattccagggcatgggcgggggcaacgtgggcagctgggagacacgggaagctggcccgtcctccgcccccgagtcaccggctgtggaccc

SEQ ID NO: 13291 - DNA, 20774 bp, Homo sapiens
gacagtgcccagggtcaccaggcaggcaggctttgcaggctccagggtggccgcagagcccctttaccaagacccctccagccccacgtggaggggagcctgaggcctggaaggagaaggaccacttgcccaaactgttcataggcaaggcagggggcctgggttctggctagtctttgtgtttcctactctgtgacctttgcgcctctcccagcctgtgtcttggtctacaacacggggacagccatcacccaccaggtccctgggcagaagtgaggaggtgtcagctgccccctgcagtgcttggtcttcatgcattgagcacctgagttgtatatagctgcacagatgggtaaactgagaccctgagcgggaataacaaccatattgggtcagagggcacccaacaccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttytaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtccygtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcaraaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacrcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactrcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctcyggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggayggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaascctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagcgtcccaggtcgtcgcacgcacctggaagattccgaaatcctcctgctgtgcatcctgccgtaggccgtgcttccaagggatgcggaagcgcgtgcggctcttgttcacccaggccacgccctccagttgccccaggtccagctgcgacaccagccagggcaggatccgtggctttggggttcccatggtccggcctgcgcgtatagggcatttcctgggcgcgaccggcctcccccggacccacctggcctggagtttccgcacycagacctccttctcacgggccacggcacaggtccttcacccatattttcgggggtacaaacaggaaacctcctcttcccatcctcccatcctcccgagaggctctctaatcagctagggttccttcccatatccatggcacatccttccccagcgtcttcagtgcagaccctccactccctcaattccgccagtatagacctcctccctcccccacatcatcgaaagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccrggctcttccgcgttacctacgatggaaggtcggggcgtgcgggcagctggaacccmcccctgtcttggrgctccgggtagctctcaaactcgaggctgcgcaccccctttcccgtcagctgagctctagagcgctggggctttcttttygatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccgkcccagtgcgcaggcgcgggaaagttgaactaataaagtttgtacgagttcagtggaggagaccgcaagttgagtggaggaggcggcggtggggccccggaccaggtcagcggggtgttgacgaggggtggggtgaggagggaagaggagggggccgggatccagtggtgggcaccccagtcccgcttctctgatatccaagggtccagggtcctctagattccagcaggggtcggagatttggaactacacctcacagcaggctgcgcggcgaagaagcgcggacctaggggaagatttgccctgaaacctcttgggattggtagttcccgatgctttaagggtttcaggagtttggcatatgcctcttatagaatccaggagttggggcgctaagcctcttcttcctgggagacctaagggtctggggctccagttcctttttctctaagactcagaagtccaggaccccagctccctcctcctttagacccacgaatctgggcacccagccccaccacctttccttggatcgaagagtctttttcctgatcgctttttcgtctgaggactcaagagtctaggcccccagacccacactctccaaaggacccaggagtccaggccctcagcaccttccttgggactcacaagtcctggtccccaagcctccacttcttgctaaacccttggagtccagtccctaaccctctctctcacaggtgcctccatggcaggctctgaagagctggggctccgggaagacacgctgagggtcctagctgccttccttaggcgtggtgaggctgccgggtctcctgttccaactccacctaggtaagaggagtggcccttctcccccaggggccagcatttgaggctccctcctaactcttgctcctggtctcagtctgtctcctctctttatatctggctctattctctgtctttggggttttggagagaggtcctcagcgsgggagggagggagttggggaaagagactgcttgcaggggatctctggtggggtcagtctctgaagtcctcctctccagaagcyctgcccaagaagagccaacagacttcctgagccgccttcgaagatgtcttccctgctccctggggcgaggagcagccccctctgagtcccctcggccttgctctctgcccatccgcccctgctatggtttagagcctggtaagagatttccatgatcatctatgaagccggcagaacacgggataaggtgctagtttaagatcactcagctagggggtggctgtgtggagtctctagcaccagccttcaggacagaaccgtcctgtcctctcccctccccagttagatttctgtcaattctgtgggttggctttcagagagcatttggtcaatctggttgttgtctctttccttccataactacttccctgcccctaggacttttgtagccaggaatacccctgatagaggggcagaagggctggttttcaatcacatctccctggctgttttagttgcgtgactctggggaaaatgctttctcttccctgctcccctgtttttccaatagcagagtaggaattggggaggaggtcactggacttgatcaaggtgacccacaagtttcctcataggtgtgaacctggacagactagtaatggctgctgggagtgctarcttgaaaaggggttcacagcttgggagaggaagtgctgtgatcaattggtgatgtctgtagtgagtgagggaaggggatactaacagtaatgtcttgtgtttgccttccttggatgagatcatcttcaaggtctagttgagctctgacagtcttttggagacagattgttgctctgtcacccaggctggagtgcaggggtgcaatctcgactcactgcaatccccacctcctgggttcaagcgattctcgtgcctcagcctcccgagtgactgggattacaggtgcacgccagcatactagctgatttttatacttttagtagacacggggtttcgccacgttggccaggctggcctcaaactcctggcctcaagtgaccctcccacgtcggcctcccaaaatgttgagattgcagacgtgagccaccgcaccctgtcagctctgacattcttttttttttttttttttttgagacggagtttcgcccttgttgcccaggctggagtgcaatggcccgatctcggctcaccacaacctctacctcccgggttcaagtaattctcctgcctcagcctcccaagtagctgggattataggcatgcgccaccatgcccggctaattttttttgtatttttagtagagatggggtttctccatgttggtcaggctgctctcgaactcccaacctcaggtgatctgcctgcctcagcctcccaaagtgatgggattacaggcgtgagccactgcgcctggccccagctctgacattctaagtccagtmtgaggatctcataaagtgaaaagtacaagggttttggcatttttaaccaagttttctcactgggcctcagtttaccccattataaaatgggaatcatggccaggcttggttgctcacgcctgtaatcctagcactttgggaggctgaggtgggtggattgcctgaggtcagcmtgggcmacmcggtgaaaccccatttctactaaaatacaaaaaattagccaggtatggcggcgtgcgcctgtagtcccagctactcatgaggcygaggcaggagaattgcgagactccgtttcccaaaatcaatacataaataaataataaataaaatgggaatcattgccacctgccaaggtagttgggggaaggagagaatccgtaagtttccaatgtcctggaaacctgtcattaactcttttcaccccaggcccagctactccagacttctatgctttggtggcccagcggctggaacagctggtccaagagcagctgaaatctccgcccagcccaggtgaggcacagaggagccccagagaaggatggcggtgggaggatagtcagggttctgcccccagccaaattctcttctgcctccagaattacagggtcccccatcgacagagaaggaagccatactgcggaggctggtggccctgctggaggaggaggcagaagtcattaaccagaaggtgatgggcatctgtcccactccttggcaaggacaggagttgcggaatggtggggcactgggatcagaagctggatctgtattttctttggatggtcaggtggaaagaggctgggacaaggtttcaatgaagggttgaggccgggtgtggtggctcacgcctgtaatcccagcactttgggaggccgagttgggtggatgacttgaggtcaggagttcgagaccagcctggccaacatggtgaaaccccatctctactaaaaawamaaaaatcggacaggtgtggtggtgcgcttctgtaatcccagctactcagaaggctgaggcaggagaatcgcttgagcccaggaggtggaggttgcagtgagccaagattgcgccactgcactccagcctgggtgacagagtgagactctgtctttaaaaaaaaaaaaaaaaaagaatagttgaatgacaggggtatggttagggtagtactgtaccgtaaattagttgttttaattgattgtttagaggggcatggcctaaatgcagagggtgtggccatcagaaacattatccacaagagactggccaagctggggaagtaagtgaatgaatgtgggggtggggggagtggctaaaatcttactgagcatagaagggacctggcttagaatgtaggggaaaatgtactaccagaggaggtgtggcttgtggctgtgtcctggaatctgattggcttcggagcttggacaaggtacatcgtcctttaatattaattgaatggtagagggcaagattgttgtagacactaggttggcccctgggaaaggtcaccaggggcatggctagattaactcagttacagtagagattggccctgattggctgttgaggcaagggcctggcatggcttagggactcacgttccaggccastatcccgggggtagtttggcagagaccctggagtctggcttgattggctaatatggatgaggggtggcctagaaccttagcatctagaacgatcctgaaccgggaagccacgcctcccggccctctattggctggccccgggggcgctgctgacgcggaccctgcctcttccaccctacagctggcctcggaccccgccctgcgcagcaagctggtccgmctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggtgagccgctgaagcctctctctccgggcctcactttacctaactgtcatgtgatagaggaggggcggggacttcttaggttcctctcagacctcaggtattctcccagctccactgcgttcgttctgttgagcccttgctgtatgccaggactgcagcgatgagtgcagacactatgcctggcgtcaacgactgggtacgctaatactgtgagcgtgaaaccagtgactgaggttactcagggagaggccggacggggtagctcatgcctgtaatcccagcacttttggaggccaaggcaggagaattatttgaggccaggagttcaagaccagcctggacaacatagtaagaccccatctctacaaaaattgaaaataactagccagggtcgggtgcggtggctcacacctgtaatcccagcactttgggaggccgaggcaggtggatcacctgaggtcaggagtttgagaccagctggccaacgtggtgaaaccctgtgtctactaaaaaaaatacataaattagccgggcgcggtggcaggtgcctgtaatcccagctaccgaggagactgaggcatgagaatcgcttgaacctgggaggcagagattgcagtgagctgagatcatgccactgcactccagcctgggcgacagagtgagactgtgtctcaacaaaataatataataaaaacctggtgcggtggctcacacctgtaatcccagcactttgggagactgaggtgggtggatcacttgaggtcaggagtttgagaccagcctgaccatggtgacattcagtctctactaaaaatacaaaattagcccggcatgcctgtaatcccagctagggaggctgaggcaagagaattgcttgaacctgggaggcagaggttgtagtgagccgagattgcaccactgcactccagcctgggcaacaagagcggggctctgtctcaaaaaataaataaatamaaatttttaaaattaataataattagcaaagcatggtagctcacacgtttactcccagctactcaggaggcagaggagccgggaggatcacttgagcccaggagttcaaggctgtggtgagctatgattgcgccactgtactccagtgtgggtgacagagtgggaccctgtctcaaaaaataaaatagtgagagtagtagtgctacctcaaagggtcgctctgagggttaaaatggggtcaatgtggtaagccctctgtgcactgcctggcatgcaggcattttgttggtgaggttatatggctacctgctgcctttccaacagtgcctgccaggatgccctcccggggaaccccctgcctccgtcctgctccttctggtgggctctggtttcacccccaacgaggccttcccaggtccccattgacaatcacagccacctgcacaccctcccaccgccctccttcccccttcctgctttacttttccttccatagcactttgggccttccaacagatggtggaattgacttgttttacttgtcttctggtttatttttctttgttggtgtctcccacctctaacacatcagcttcaggagacccagaagtcttcccctctccttttcttactttatctccagtgccggtttcagagttggattgggctccagcgtgctggccctgtggcttggcgactgtcgcagtctccctgagcggcactctccccactggtccagtgagcaccgtctcatttacctgccttggggggtcgctgtgggtattcactgagagagggacacaagccaggctctggatggaaccggtttccctggcaggagctggtcaagtgtgtttgaggagcagggaggaggaggccagtagggctacagtagggtgagcgggcgacagatgagaggaggagaggcgccgggccagccaggaccctgtggtcacggtgagtgacaactcggactttgactctgggtaagccaaggtctctgagcagcggagggacaggcgctgatttaggcgctaatgggcgccctctggcggctgcctggggacagactgctgggggcgagggcagaagtaggggcacagggaggaggtgagtggatctcacccaagtcgggggcggtggagaatgctggatttaacttagcggtgaagctgacagatttggctaatgggccagatgtggggacagactaaaggatgctggcccgagcagctgcagggcgacatcttaagttccccgagatggggaaggtgtggggatgggggcgatgggggtggggagcaggactggaggtggtccggtctacagtaagatcagaactcatagcacatgttgaggggaatggatataagtgttgggctcagcaaagaagctcgtttattttattttattttaatttttcagatggagtctcactctattgcccagactggagtgcagtggcacgaccttggctcactgcaacctccacctcctgggttcaagcgattccctgcctcagcctcctgagtagctggggttacaggcgcacaccaccatgtccggctaattttgtagttttagcagagacggggttttgccctgttggccaggctggtctcgaactcttggcctcaagtgatccacccacctcggcctcccaaagtgctggaattacaggctgagctaccacgcctggacaatttcttaaaaaatttttttaaagtaggattgatagcagatgagttttctcggtgggccaggtcctctgctagggatttcaatggaatgatcccatttaaacccactacaacctcatggggctcttattgtcctcgtcttgtgggggcagagaggaaaagtccccagcatgcagagtgttggaatctggatttgtacacaaagccacgactctgaattgttcaaatcccaagactctcttccccatctctgactctgtcccccractcttcactctctctggatctctgtctaatcccactccagtgtcctgaccctcctygagctcaacctttcctcctcctgctaggaccctgccccctcayccctgtgcccttctgtctgggtctctgtccccttgtstgggtgtctgtcaccctccgctctctggttcctcgccttcccgtctctaatctcacagggctgatgtggacgctgctgtatggggggaacacctgccctgctcacagggctctgccacttttcccttccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaartattcaattgtctgttcttacacttgggaactaaagttttaaggagaggagatttggttcagagatttctgtggcttacgcaaattgaggaaagaaccagttcattcattctagaaatatttatttgcagcacctacaagagcctgtctcctggacatgtaacatatttgagagaatacctgtaaatattccagcaacttgcatttttttttcctattgcacgatctggttattctagctaatgctgtatgatggtcatggagtctttccagtgaattccacagaaaggtacagtctaacttcacctgtgtctaggacaccaccctcttcttgtttttctcctcccattgctcctttcaagtctctcttgctggtttctcatctacctacagaccagtggtttgtctcacacacaccccccactctccctttttttttggagatagggtcttgctctgttgcctatacttgcactgttatatagatacagtggcactatcatggctcactgcagcctcaacctcctgggctcaagtgatcctcccacttcagcctctctagtagctggaactaaaggcatgcgacacgacgcctagctaatttttaaaaaagaatttttatgggaggccaaggcaggtggatcacttgaggtcaggagttcaagaccagccaggccaacatggtgaaaccccatctctactaaaaatacaaaaattagccgggcatggtggtgggtgcctgtaatcccagctacttgggtggctgaggcacgagactcgcttgaacccgggaggcaagaggttgcagtgagttgagatcacgccactgcactccagcctgggcaacagagcgagactccgtctcaaaaaaaaaaaaattgtagaaatggggtctcccttatgttgcccaggctggtctccacctcctgggctcaagtgatcctcctaccttggcatcccaaagtcctgggatcacaggcatgagtcactgtgcctgggcggtttgtctcctttatagggccatatcccccttcacagagtaatgtttgtaaattaataagtgaaatgtacaggattacaaaccgaaccaattacagttgatcctcagtatttgtagattatttgcaaatttgcatccttgctacaatgtattcataccccaaaaattaaggcagtgcttttgtggtgttttggagggcaatgcttatgcacagagctgcaacaagctaaagacctgatgtgcatatttgcagctgggctcctcttgcttcagctcaaacactggaaacaaatgtccttttcttggtttgtttagtgccatgcttttcaatttttttttttttttttaaagttagagtctcggtctgtcgctcgagctggagtgcaatggcttcatcctggctcactgcaacctccacctcctgagctcaagcgattctcctgcctcrgcctcccaagtagctgggattacaggcgtgtgccaccagtcctggctaatttttttatttttatttttatttattttattattttttgagatggagtctcgctgtgtcgcctaggctggagtgcagtggcaccatctcagctcactgcaacctctgcctcccgggttcacgtgattctcctgcctcagcctctggagcagctgggactacaggcgcccaccaccacacccggctaatttttgtttttttagtagagacgggggtttcaccatattggctaggctggtctcgaactcctgagcttgtgatccgcccacctcagccttccaaaatgctgggattacaggcgtgagtcaccgcgcccggccaaattttttttttttttttttttgagacaagagtctcgctctgtcacccaggctggagtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgggcgttcctggcagggggagggacttggcaaaaaccaagtggcttgagaggggttgatggttttaaaaaacttggaatgattatgtcaagggctagggatttaatgtgttgacgacggactcctattcctcacttgcttcgggaccccagctatgcccttcctctctctgggcctctcaccgattccgtttttcccccaggtaatgagcacaagctccctttttcctccagactccccccgggttgggaggatccaccgagtggacgaggagtgataattcctttgagccaatcgttggtgcctgaagccccgccttcttccctacccgtgggccaattgccgtgttctccttgaggccrgccgcttggcgagggtgggccaaaggctgcgtgacgtcgcttccggataaaccaatggcagcgattaggaggcgggtcgttttggtgatggacaggtgtttcaagacgcccctttagcgcggggctccccgggaagctttgaggcggtgctgggtgtaaaggggagggcattcctggtggattttgcccaatcaccagtcgcgcttsttgcaatagacgggcagttttccccatcccgggtcgacttgagggggcgggattctggacgccagagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcggctccacgtgcgggacaaaggccccgcccccggccgggrakgggcgcccaggggggcggkgagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttacyctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcataycctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctc

SEQ ID NO: 13292 - DNA, 28524 bp, Homo sapiens
ggatcacgaggtcaggagatcgagaccatcctggctaacacggtgaaaccccgtctctactaaaaatacaaaaaattagccgggcgaggtggcgggcgcctgtagtcctagctactcgggaggctgaggcaggagaatggcgtgaaccccrggaggcggagcctgcagtgagccgagattgcgccactgcactccagcctgggcgacagcgagactccgtctcaaaaaaaaaaaaaaaaaaaaaaaaaaaaagaatmctggccaggtgcagtggctcatgcctgtaatytcagcacttttggaggccatggagggtggatcacttgaggtcaggagwttgagaccaccctgaccaacgtggtgaaatcccatctctactaaaagtacaaaaaaaaattatctgggcatgatgctgcacacctgtattcccagctccttgggaggctgaggcaggagaattgcttgaacccaagaggcagaggttgcagtgagccgagatttcgacaatgcactccagcctgggtgaaagagcaagactccatctcaaaaaaaaaaaaaaaaaaaaaagaatcctgaccctgacatcacaccatatacaaaaataactcgaaatgtatcataggtttattgtaaaagctaaaactaaaaatatataagtaccagaagaaaatataggagaatagctttgtgccttttgagtagacaatgatttcatagacaaaaagcactaaccataaaaagtaatccaatygatataaactgaactttactaaaacttcattaaacttctgctcttcaaaagacaccattaaggaaaataaaaagcaaaccagagactaagggaaatatatacagacagtccccagtttaatgatggcatgacttagaatttttcagttttacaatggtgtacaggtgatatgcattcagtagaaattgtatttcaagtacccayacagccattcgatttttcctgttaagtgcagtattcaataaattgaatgaaatgttaagcacttcatttaaaaatagtcttgtgttggatgattttgcctaagtgtaggctaatataagtgttctcagcatgtttaaggtaggctaggctatgatgtttggtaggttaggtgtatttttttttttttttttttttgagacagagttttgctcttcttgcccaggctggagtgcaatggcacgatctcggctcaccacaacctctgcctcccaggttcaagtgattctcctgcctcagcctctggagtagctgggattacaggcatgtgccaccacacccggctaattttgtatttttagtagaggtggggtttctccatgttggtcagactggtctcgaactcctgacctcaggcgatccacccgccttggcctcccaaagtgctgggattgcaggtatgagccactgcacccggccaggttaggtgtattaaatgaattttcaacttaacaatattttgcaattatgatgggattatggagacatgacttcattgtaaactgaggagcatttgtatacagatatgacaaagcttgtatccacaatacgtaaaaaactcttacaactcagtaatgagacaaagaacccaattaaaaaatggacaaggccaggtgtggtggctcacacctggtaatcccagcactttgggaggctggggcaggtggatcacctgaggtcaggagtttgagaccagcctgaccaacatgatgaaaccccatctctactaaaaatgcaaaaatcagccaggcatggtggcacacgcctgtaatcccagctactcgggagrctgtgacaagagaatcacctgaacccrggaggmggaggytgcagtgagccragatggggccattgtactccaacctgggcaacaagagcaaaattttgtctccagggtgggtgggaggtgggcgaggtagggagggaagacaaaaaatttgaacaagtttcagaaaaaagatatataaataactaataagtacatgaaaagatgttcattgcatttaattttaatgcaaattaaaatcacaatgagatactaccacacactcacaagtatgattgtaactaacagggctgacattactaagtactgatgaggttgtataacaattggggctctcttatacacctgatgaaaatgtaaactggtaacaacaatttggcattttcttcagttaaatgtagctgggtgtagtggctcacacctgtaatcccagaactttggggaggccaaggcaggaggatttctcaaacccaggagttcaagaccaacttgggcaatatagtgagaccctgtccctataaaaaataaaatcaattttttaaaaaagagttaaatgtgcatttacctatttgatccagcaatttcactcttgggtatttacccaagaggaagaaaaagagacatgtttacacaaagaattgtatacaaatgttcacagcagctttattcatgaaagcctaaaattggaaataacccaaagtacatcacatcgacagaagaatatacaaatcgtagcatacctatgcaatggaatactattcagcaatgaaaattaaccaccaatacacctaatcatgtagaccgattttayagaaaagctgaagaacagcctggccaacatggtgaaaccccgtctctactaaaaatacaaaaagttgtatagtgagaccctgtctcaaaaaaaaaaaaaggaaaagctgagcaaaagaacacacaaaagtgtgcacaatgcatgattccatttgtatgaagttctataatagtcaaaactaaactatagagacagaaaragcagtatttgcctgggactaggagtaggaggatagctgctaacacacagaattgkggggkgctggccaggcatggtggctcacacctgtaatcccagcactttgggaggccaaggtgggtggatcacttgaggtcaggagttcgagaccagcctggccaacacggtgaaacctcatctctactaaaagtacaaaaattagctgggcatggtagtgcatctctgtaatcccagctacttcttgcaaggctgagacatgagaatggcttgaacccgggggkctgaggctacagtgagccaaggtcaagccactgcactccagcctgggcgatagaggaagaccctgtcttaaaaaaaaacaaaaaaacaaaagaacttttggggtgatgggaattttaaatatcttgactggagtagttacataagtgtatgtatacatttttcaaaattcataaattttcaggtgcaggacagacttaaactgaatagctacatttcatccttgattatctttgacctcacttacaaataattaaccacatgatagtctgtcatatgtcatagttccaagttttcttaaacaaaacagaacatggacgaagcgctcaataggcattctagtagaaaacaaacccaagttttgcaccctcttggctgctgcatgtttacttcctgggagcatgtcctaccatatcagtttcctattgccgcttcatgaaattgccacagacttaatggtataaaacgacacacattgttttatagttctggaggtctgaagtacaaaacaggtctcactaagctgacatcaaggtgtcatcagggtagcatttcttctggaggctctgggggagaatccattccttgccttttccagcttctacaggctttcctcattccttgaatcgtggctccctttgagccagcaagcagaattctgctctcatcctcatatctccatttcgcatcctgaytctgactcttctacctccctcttataaggaccctgtgattagactgtgcccacctgcataatccaggattgtcttctcatctcaagatttttaattaacgacaaagacccttttggcacttaagttcatatgtttaacagattccagggatcaggacatggatatcrytgatggctattatcttaccttttttttttttttcyttttttttttagacgtagtctcactctgttgcccaggctgcagtgcaatggtgagatctcggctaactgcaaacttccctcctgggttcgagcaattctcatgcctcagccttccgagaagctgggattacagtcacctgccaccacacccagctgacttttatatttttaggagactgggttttgccatgttggccagggtggtcttgaactcctgacctcaggtgatcctcccatctctgcctctcatagtgctgggattacaggcgcgagccactgcgcctggcctaacctacttttattctacaatgattctactcttacctaacttagaaaaacttggtctctgaagggcctttattgatgatgtgggatttctgccccttsttcaaaacactggtctgcccctgtcgaaacacctgctttatctcatggaggctccaggttgactttcataactaagtaaagtcttgtatgtaggattcgggtttcaggttcatggggccttgagattcaaagttcaggagttctagatttgagacactagagggagacttaggccttgaaaaagtgacctcaattctaggagtaagtgctgagactcasaggaatttttggcttgaacttgacccagggttcaggcaacagagagcaatggcatagggaagtatggcatttactttttcaagggggataaaaaagcagaagtggctgggagaggtggctcacgcctgtaatcctagcattttgggaagctgaggcgggtggatcacctgaggtcaggagtttgagaccagcctggccaacatggagaaaccctgtctctactaaaaatayaaaaattakcctggtgtggtggtgggtgcctgtaatccctgctacttgggaggctgaggcaggagaatcacttgaacctgggaggcagaggttgcagtgagccgagatcgcgccattgcacttcagcctgggtgacaagagcgaaactctgtctcaaaaaaaaaaaaaaagggcagaagtggacttggccacacacttaatcttagattcaaggatgaagagagcaccaaagacctgtacacaaattagctgactcagaggccaaggtccttctcattttgtatctaatagctcccctcccctctccaacacggatgtaggacagagagcaaaatgagaggaagttggaaataggtgaataacagctgaaagccaaggccacagtgtgctcaccagataacataaaaattttcaagctatagttacagattaagtctctcttaactttatttttcctctcatctctccattaaagaatgatgcatcctaggctaggcacggtggctcatgcctgtaatcccagcactttgggaggacgaggcgggtggatcacctgaggtcaagagttcaaaaacagcctgaccaacatggtgaaaccccgtctctactaaaaatacaaaaaattagccgggcgtggtgttgggcgcctgtaatcccagctactcgggaggctgaggcaggggaatcgcttgaacctgggaggcagaggttgcagtgagccaagattgtgccattgcactccagcctgggcgacaagagcaaaactcygtctcaaagaaaaaaaaaaagaatgatgcatccttgatgcagagtaggagataatgaaaaataaataaataaaacaaaacaaaacaaaaaagaatgatggatccaccttgccttaatctttatttaaagaaagagaaagtttaccaaattcagatgtcattgaagaactttggaatttggtacccagtgatccaccctacaaaattcatgtcatttgcatcataggctttctcatcactaaagatgcaaatccccacgataatgtccctctcagtcggccccctgtttgtacagacagctcagattcccataactgcctgagatgygggaatgagtcatcctctgcccaagcaggtggcagtgggcacacctgaagcaacaaagtccaggaacaatcagcacaacttatgactccagaggaggaagtccagagacagagcaccatgacttctgagaaaggtaaaatgkatccgggggcttggcaagtattcttgaacaatgcaagaatggtgtgtgtgtgtgtgtgtgtgtgtgtgtgtgtgtgtgtgtgtgtgtgtgtgtgtcctgctgattcttgcatctgtgggtgttttcaaacttccctattattgattaatatattagtcttaaataagatggtttattattagtaaatatttacatctccaagtgactttaaccaaatcagtgtttgtttcaccatgataaaaaattaagtagccaggcgctgtggytcacacctgtaatcccagcactttgggagtccaaggagggtggatcacttgaggcccagggtttgagaccagcctggccaacatggtgaaaccctatctgtactaaaaatacaaaaattagccaggcatggtggcgcatgcctgtagtcccagctactcgggaggctgaggcaggaggatcacttgaacacaggaggcggaggttgcagtgacctgagatcacgccactgcactccagcctgggcaacagagcaagactctgtctcacaaaaataaaaaaaaagttaagtaaaagtacaactgtttaaataacagtttaaggtaacaacagacgtgatagcatgagaacaatgtgctaattgacaaatgaattgactataactaattgataaatttgtgcacagtcagtgttagaaaaatgcatgggagaggaagaacacttcaggctgaaggaagtaatttcagctgagctaggatttgagctggattctaagagaagtgtagacctaaaaaaatttttatcttattttgtttttagagactagcgggtgggttcactacttcgcccaggctggtctggaactcctgggctcaagcaattctccacccttggtctctcaaagtactaggaatacaggcatgagccaccatgcctaaccaaatttttttttttttttttttaagactcgccctgttgcctaggctggagtacagtggtgtgatcactgctcactgctgtcttgacctcctgggctcaagagatcctcccgcctcascttcctgggtagctgggacaacaggcaygggccaccagccctgctaatttttttgtagagatgaggtcttgctttattgctcaggctggtcttgaactcctgggctcaagtgatccactagcctcggcctcccaaagtactgggattacaggtgtaagccaccatgccaggccagaagggcagactttggatcgacaaagaagaggagattccaggttgattgaatcctattgadraacagaatttaaaagcttttatagagacttgtgtctggaatataatgaataaactggttaggctacaaaaaatttatgtaaacaatttgcagtaagaccagaaagcaaatttgaagtgttattrtactatagaggacttcgaatgccaggctcaaggaatgaaagtttttctttatggtagagggaatatctttggagaatttatgaatagcacagagatatgactaaaatagtgctttagacacatttacttgacatgtgatgggttttggactggaagcaaggagaccagttagaaractattgcaatagtgtgagtgtgatggggcagaaggtaatatagatatcagtttggagttgaagtaacaatttattttctcctttatgttcttcatctgttagaattcttttttaaggtcaggtgtgatggctcacacctgtaatcccagcactttgggaggtcaaggcaggcggatcacctgaggtagggagtttgagaccagcctgaccaacatggagaaacaacgtctctattaaaaatacaaaattagctgggcacggtagcacatgcctgtaatcccgctacttgggaggccaaggcaggagaatcacttgaaccagggaggcggaggttgcagtgagccgagatcgcgccattgcactccagcctgggcaacaagagcaaaactccatctcgggaaaaaaaaaaaaattcttttttaagtggcatactgggggaaagaccaaacacattatttgattgtagtagctaataccttccctggacttttcttatgaaggtggtgtgttctatacctcaaactgtccccagtcatgtggctggtatccttgtctttgcatcccaggaataatattgatcagtgtagacacagcatatgtctcaccgtccctttctgaacttctcactgctgcttcagctctttcagagaaagtgtcttcccatcatcaaatgcctttttcctmtgatgtggcctctgtttatgtaaggctccctcggagtagattactggttcaagggccccaatttgcactaagatctgagaagagctcattccaacgtgccagccacccccttcctccttcctcccaatgctcaaatcccccattcctcctttaaaagtaagagatttgttcttcaggtcacacttggaatagtgtttcctgacttcgtcctatttcctagatatctggctaatttctcattttagttcttctccccagctagaaccactctctgcaaaaaaaccatgccatgcccaagtcctttctacaactcctctaccatccagtgcaaatgcataaaaagtaacacacacaaacaggtacacacacagcctagggtaaagcatgctctgttttaaaggaagtgtcttccagagcctgtgactcttctytgttcaaaaatagcacctgcgagttaaggtttggccaggagcgtgggatgaatttcttgcctgcatctccccaaatcacccttagaggttcaggccttgtcagcgcccattttattgccaggaacatccccaagcctctragtcctgagaggcgcaggtctctaaaattcagtactctcccttgaatcatccccatactctctaatggcttcttacacttagcatactatccagagctggtaaggccctgtggcttaccccctccattgctcatctccctccattgcaggtcttgatcactccgacccagccargctgacttgcttgctcttccttgaacaagtcaaggtccacacttcaggtcgtttgcacctggtgttcccygtgcttggaaagctctccccttccccgacgtccacatgtcttgctctctaaatttacattcaggtctcagctttaatgtccctctttatagatgtcttctctgactgccatctctgatatggtcgatatggtgcccccaccaccttttgtctccttccagtacttttcttcttcctytttttttgagatggagtctctctcgctctgtcgcccaggctagagtgcaatggtgtgatcttggcttactgtaacctccacctcccaggttcaagtgattctcctgcctcagcctcccgaatagctgggattacaggcacgtgccaacatgcccggctaatttttgtatttttagtagagacagggttttgccatattggccaggctggtttcaaactcctgaactcaggtgatccacccgccttggcctcccaaaagtgctgggattacaggcatgatccaccgtacccggccgtctttttttaaatttttaaattttttttattttttaaagacaacgtcttgctctgtcgcccaggctggagtgcaatgrcgatcatggctcactgtagcctcgaactcctgggctcaagtgatcctcccacttcagccttctgagcagtggggactactggtgcacaccaccatgcccggctaatttaaaaaakttggttttgttttgttttgtttttagagacggggtcttgctgtgttgcttayggtagtctcaatttcctagcctcaagcaatcctcccgcctcagcctcctgaagtgttgggattataggcatgagctatggcacccagccagggactcttttgactaagggagagatcaagataatccccactccctgaagccctgtgcattgggaatttagatgactgctcatttccacatcaattgttacttcccatctctcaattctagtgctggacctactattaggttctatacctaagagcagcaattgttgcttttttctctttccccttccaggttagcacgattcaaagggagaatctgtgtccacttgaggtcccttatgtagcaggactgccctgtaaatgtcttcaggaaccacttggctccagttggagcctggtccttttttgctggttcaataggatctttccatatgttctttacaagtatctttttacacttattactcattcagttatcttttctccttcctctcgagttgtggtttaaaatatgtataattacaattataaagagatatctatctatctatctatctatctatcatctgtcatcaaagatatcstggcttctctccacactaccaaatactctttcttattttttaattataatttttatttcagattcatggggtacacgtgcagatttgttacaagggtatatattgtgtgatgctgaggtttgggcttgtattgactctgctaccgagatagtgaacatagtacccaatgggaagtttttcagctctttcccctctccctccctcagtccttttggacttttccagtgtctattgttcccgtcttttttttttttttttttttgagacggagtctcgctctatcacccaggctggagtgcagtggcgcaaatttggctcactgcaagctccgcctcccgggttcacgccattctcctgcykcagcctcccgagtagctggaactataggtgcctgccaccacaccaggctaatttttttttttttttttttgkatttttagtacagacgggatttcaccatgttagccaggatggtctcgatctcctgaccttgtgatccacccgcctccgcctcccaaagtgctgggattagaggtgtgagccaccatgcctggctgttcctgtctttatgtccatrtgtacccaaggtttagctcccacttataagtgagaacatgcaatatttggttttctgtttctgtgttaatttgcttaggataatggtctccagctgcatctatgttgctgcaaaggacatgatttatgatttcattcttttgtatagctgtatagttttccatcaaatacccttttttttttttttttttagatggaatctcattctgtcaccaagggtggagtgcagtggcacattcttggctcactgcaagctccgcctcccgggttcaagcgattcttgtgcctcggcctcctgagtagctgggattacaagcatgggccaccatgcctggctaattttttgtatttattagagacggggtttcaccatgttaggctggtctcgaactcctgaccctcaggtgatccacccacctaggcctcccaaagtgctgggattacaggtgtgagccactgtccctggcccaaatacccyctctttctttctttctttcttctttctttctttctttctttctttcyttctttctttctttcyttcyttcyttccttccttccttccttccttccttccttccttcccttccttccttccttccttcctttctttttttgagacagagtcttgctctgtcacccaagctggagggcagtggcatgatctctgctcactgcaacctctgcctccygggttcaagcaattctcctgyctcagcctccagaatagcagggattacaggtgcctgccaccacacctggctaatttttgtatttttagtagagacggggtttcaccatgttgcccaggctagtcttgaacccttgaccttgtgaaccacccgcctcagcctcccaagtgttgggattacaggcgtgagccaccgcacccggcccaaataccctttctttaaattgaaactttattttattttatttatttatttttttgagacgtagtctcgctctgtcgcccaggctggagtgcagtggcttgatctcggctcactgcaagctctgccttccaggttcacgccattctcctgcctcagcctcccragtagctgggactacaggcgcccgccaccacgcctggccagttttttgtatttttagtagagttgggttttcaccgtgttagccaggatggtctcgatctcctgacctcatgatccgcccacctcggcctcccaaagtgctgggattacaggcatgagccgctgtgcctggccagtagttgcatttttagtttttcttttttaaaataaatttgcaaactgttttccagtatggctgtaccagtttacattcccaccagcaaagtatgacagattcagtttctctgcatccttaccagcatttggtgttttgcatgcgtgtctgtgcacrcacacctatacacacacatatagccattctgataggtgtgtaggaatatctcattgtggttttaatttgtatctccctggtgcaaattaaatggtgagttggtcacaagtactccaggttgccggtagttccttttgtgtgtgtgtgtgtgtgtgtgatttttaaatttcaaatataaayatatatatatatatatatatatatatwtwtttttttttttttttttttttttttttgagagggagtttcactcttgttgcccaggctggagtgcaatggcgcgatctcggctcactacaacctccacctcctgggttcaagcaattctcctgcctcagcttcctgagtagctgggattacaggcatgcgccaccacacccagctaattttgtatttttagtagagacagggtttctccatgttggtcaggctggtctcgaacacctgacctcaggtgatctgcctgcctcagcctcccaaagtgctgggattacaggcatgagccaccgcgcccggcctataaatatatttttaaattttctttttttggtggaagtgcttttttttttttttcttttgacatggagttttgctctcgttgcccaggctggagtgcaacggcatgatctgggctcaccgcaacctctgcctcacagattcaagtgattcttgtgcctcggcctcccaagtagctgggattacaggcatgtgccaccacacccggctaatttttgtatttttagtagagacggggtttcgccatgttggtcaggctggtctcaaactcctgacctaaggtgatccacctgcctcagcctcccaaagtcagccaccgcgcctggcctaaattttcaatcaatatgtgccaagtgattattatttaaaaatattagcttgagaagagttctcagactcaattttattgtcatgagcctcttacagtgaggtctcacagacttcctttttccttcatgccactgactctgagaccatctggcactgtgacacctctgttgggtaatcaagccataaatcaaaatctttagtctccaattcctgtatcgcctttctcaaaacgcagcctgagtctgaaaaataatgtacctgtaaccaaggactccaacacctatttaatcatctatcaaacctgaaataaaaacccaattttggccgggcacggtggctcacgcctgtaatcccagcactttgagatgctgagaggggcagatcacatgaggccaggagtttgagaccagcctggccaagatggtgaaaccccgtctctactaaaaatacaaaagttagccgggtgtggtgacacatgcctgtaatcccagctacttgggaggctcaggcacgagaatcacttgaaccctggaggcaaagtttacagtgagccaagattgcaccactggactccagcctgggtggtggagtgaggttctgtctcaaaacaaaacaaaacaaaacaaaacaaaacaaaacagaacaaatcaatttccaggtgattctatttcggaaattggaagaaattagggacttttgatcagtccatgcatttttgtcatakacttcaattcttttccaggaaatagttttgggtattttttttgttatttatttataattttagtttaattattattatctttttttgagacagggtctgtctctcttgcccctgctggagtgcagtggcatgctcatggctcactgcagcctcaacctcctgggctcaagtgattatcccacctcagctttcctagtagctgggactacaggcatgcaccactacagctggttaaacttctgtatctttttgtagagayggaaatttccccattttacccaggctggccttgatatcttaggcttaagcgaccatcttgccttggcctcccaaagtgctgggattacaggtgtgagtcactgcctacagcctggtttttkttttttaattttgttttgttgttattgattgtttttattttaaggaatttagtagctctagatgcaggcttatcttcagttttccacagcccttgctcactttcttttcatgggaatggcctgggcctaccgtagaaagcatacttcacagtatatggctagccctctatatgaaaaataaaacgtcagaaagtgtgcaatccacctctctccagccttaaaggtgcaaaaagcctcagagtcacttcaaaagtgttctgactttggagacatattccaaggactggctcaacttaggttctatgttatgcaactagacattcagctaacaatttggcagtcatggcgaggaaacatacacatgaggctcaattcaagggtagtaacttagtacgaaatgcagttggttcaaatgattctggctgggatgccaaatatgtaattgagatgtttatgttaccagtattattagttccctttttcctctgttaaatagctatttcacacacacacacacacacacacacacacgtatatacaacacactaggacaccaagtgggtatttttgcaacccaaactaaaaatccataagcatatgcatggcaaaccgaatagtagagataagaaagagaagtattcttacacaggaggctctcacctcctcaaaattcccaagttgacatttaatgtcaatgatgttcatgccattgaaataaacataaaacaggcatctttctaaccytctgaaaggctgccgtaataacagtgcttaacgtttatgaagcatctgctgcgtcaggcaccttgcaaatgttttccattcattgtgttacgtgagtcttccgacaaccttgtggaataggcaatcttagggtctacatttgacaaatggggaaactgaggtctagagaggttaggaaacttgccaaatgtgttagagcaagtaattggctaaactgggattataacccatttttctctgaccctagagccttggctcttgattgcaacactgtgttgcttctttagactagactgagattcatggaccattttaagtttgtaaccacctttgagagtctgaatggaggacgtggttttgcctggttttacttcctcctctagagtgcggggtccatattcctctgatgataagggccaggagagccatctaaacaaagtactgcttagatcactccaaagccggggccactcacactgcaccccaggaaactgaacctctgtcctttccagcccagactttcttccacggagtgacactgattagtttgtaggccaggtgaggcatgatttcataaccatggagtaatctgaccagggtcatgcaggggagcagcagrcctgcggtatataaattctcaaatacacatcttccatttatttccttatttctttctttaaaaaaaaaaaatttggcctaggcatggtgaatcatgcctgtaatcccagcactttgggaggctgaagcaggaggatctcttgagctcaggagtttgagaccaacctgggcaacacagagagaacaygcctccacaaaaaaaataacaaatgaaataaaattttaattttttaagagacagggtctcactgtatcacccaggctatgtacagtgacataatcatagctcacagtaacctggaactcctgggctctagtgatcctccctcctcagccactcaagtagccacaggtgtgtgctaacacaccctgctaattttacattttgtaggaatggggtctcactgtgttgcccaggctggtctcaaatttctggcttcaagagatccttctgccttggcatctcaaaaagctgggattataggtataagccactgcactctctctctatatatataaaatcaaagccccaccaatgccacctccttttctattttccaaactactccaccaccatggtctgcaccactccctgtgaggcccctcaaagctgtccatgcccatgtctacattaggcttctctacccatcgtgtcataacatttcctgtatttccatttctttctttctttttttttttttaaggagtcttgctctgtcactcaggctagagtgcagtggcgtgatctcggctcactgcaacctccacctcctgggttcaagcaattctcctgcctcagcctcccaagtagctgggattacaggcatgcgccaccacgcccagccaatttttttttgtatttttagtagagatgcggtttctccatgttggtcaggctagtctggaactcccgacctcagatgatctgcccgcctcagcctcccaaagtgctgggattacaggcgtgagccaccacaccgggcctatttttaatttttatttttgagacagagttttgctcttttgcccaggctggagtgcaatggtgcgatcttggctcactgcaacctcctctccccaggttcaagtgattctcctgcctcagccacccgagtagctgggattataggtgcccgcaatcacacctggctaatttttgtatttttggtagagacagggtttcaccatgttggccaggctggtctcaaactcctgacctcaggtgaaccacctgcctcggtctcccaaagtgctagaattacaggcgtgagccaccgcacccggcctctaagaggctttaagaagtgactttcccattgtgcttaatcatttttgttgaagccttaaggcagactaccttgtttgggattgggcatctgggaaaagagattttggcagagtccttaaaaatcttgcttttcttgggtacaatgagctggtccaatacaattaatccatgagagaatcttcaaattccattttctgagatgatttggaggtttggaataatagagcactttttcttagcaactcatttgatatttgagtgttgtttgacataatcatatcttggtcaacaggtccttcaaccggtgaccccactctgaggtaagaataacactatcacagtgcccatttaatttgatcaagaatcaatgggtatttaagagytgtgcatggtggcacatgcgcctataatcccagctactcaggaggctgaggcaggagtaggaggatcgcttgagcccaggaggtcaaggctgcagtgagctatgattgcaccactgcactgcagccggggtaacagactgagaccctgtctcaaaaaaaaaaaaaaaaaaggaactgtggatatagctttctttattgttccttttctcttttgccattttccattctttctttcatttttgccttttccagtttcattttctatggttattgttttttatatctttgctcttatgtcttttgatctctttaaataaatgattttctagcttgcttatctgttattgtcttacaatttctcttctttttttaaatcgcatgcttttatagccattagtgaaatacctgggaaactcatttgtcactttaacttcatcttcgttttataatgtctgcccatttttcagacataggacagggaagtcatgttaaggaatatattatctcttgataggtggaaggattgatctatgtagtaaatgaatgtgatactttagggatgagtgggaactrttaggatgtaataagcttgtgacttaaccatattgcaaagaagagtctgcagttcaattctgagtttcccttgagttacagctttcagacatagagagtgttaaatctaaagacaccactgagagcaagtagaatttctttcttataggagttagtatatagaatcctaatgtggaagaatcttgaggctaaattgctcttttgtctgttcttgacaatacaatcttgttggcaatttgaggcgtcaacacttgagaaaatctggttagagtccattgaggaatagaaaagataaggattggaacatagcacctctaggtgtaaaatagaaaagttagaatatagctaggcatggtggggcacacctgtggtctcagctactcaggaggctgaggcaggagagtagcttgagtccaggaaggggagatcaggctggccagcttagagagaccatgtcttaaaaaaaaaaaaaaaaaagggttagaatataatgaaggaaaatttaaaagagaaacaaagacacrcttacacctgaattcaagactaaaacataatggtattagagagtggtcaccaaataatgtgactgggggaagaaacctgtgcactatgtttgtgagaaaaaaaaatctgataattcaaacagacctcttcagataactttgagacatatactagaaaaagaagtttcctgagatgttatgtctcagatcagcctgatagaagaggggagcagaggctgggcgtggtggctcacgcctgtaatcccagcactttgggaggctgaggtgggcgaatcacaaggtcaggagtttgagaccagcctggccaacatggtgaaamcccgtctctactaaaaatacaaaaaaaattagctggacatggtggcgggagcctgtaatcccagctacttgggaagttgaggcagaaaaatcgcttgaacctgggaggtggaggttgtggtgagmtgagattgcaccactgcactccagtctgggcaacagtgtgagwctccatcttaaaaaaataaaataaaataaaataaawtaaaataaagaagaggggagcaggaaaagatttctaagatctctctaaatrtggcatgacagtgtgggctgctttttgtatttcaggagaagaatcgaaccctrggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatsagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcaggtaaaaacagtaaacaaagaaacttcattgtttacaacagactgtggtgatagtagctgtttttaggccagaagattggttagcccaggctggaagtctcagaagtaaaagtccaaaataatgtcataaaggactaggtctgaaattcatgacaaggaaagttacaaaaatacaactcctggctacgcatggtggctcatgcctataatcccagaactttgggaggccaaggcaggaggatcacttgaagccaggggttcaagatcagcctgggcaacatagtgagaccccatctctaaaaaaaatttaaaaatccggccaggtgcggtggctcacgcctgtaatcccagcactttgggaggccgaggtgggcggatcatgagatcaggagatggagaccatcctggctaacacggtgaaaccccgtctctactaaaaaatacaaaaaaattagccaggcgtggtggcgggcrcctgtagtcccagctactcgggaggctgaggcaggagaatggygtgaacccgggaggcggagcttgcagtgagccgagatcgcgccactgcactccagcctgggcgacaragcgagactccgtctcaagataaaataaaataaaataaaataaaaaataaaataaaaaaatcagacaggcatggcagcatacacctttaaaggctgaggtaggaagatctcctgagcccagaagttcaaggctgcagtgagctatgattggaccactgcacactggcctaggtgacagagcgaaaccctgtatcaaaaaacaaaaacaaaaacaaacaacaactcttttttttttttttttgagacggagtcttgctctttcgcccaggctggagtgcagtggygcaatctcgactcactgcaagctccacctggggttcacgccattctcctgcctcagcctccccagtagctgggactacaggcgcccaccaccacgcccggctaattttttgtatttttagtagagacggggtttcactgtgttaggcaggatggtctcgatctcctgacctgtgatccacccccctcggcctcccaaagtgctgggattacaggcgtgagccaccgcacccagccaacaactcttttctctagtcttgcctctcagccatctttaaatgaactgctttattctttttagggggtctaatgtccagcagcaactagactagagactacaggctttctatacgggaagctaggttggggatcttcttaagtaatttaccattgtgcttgttgaatgagccaagatttgtgtttccttagagtattatcactgctggaggaattttgtcaactacccacctggggatgaagctcactggccacaatacccacctctgtggatgatgttgtaygcactggagctgcactgcataattctagtaagtcactttagggacacaaatgttgatgcaaaaagaagcatccttcttcaaagktctttcctgagaaaatytgactcatatcttctttttgacatttatattgagatttagttatttaactagctagctcctcttaagaaaatctcagagccaggtatggtggtgcacacttgtagtcccagctacgcaggaagcttgagtctaggcgttgcaagctgcagtgagctatgatcacgccaatatgctccagcctgcgtggtataacaagatcctgtttctaaaacacagctgggtacagtggctcatgcctgtaatccaagcactttggaaggccaagatgggaggattgcttgagaccaggagtctgagaccagcctggccaacataatgagaccccctctctataaaaaagaaaattatgtatcaaacaaastaaacaaacaagcaaacaaacaacatctaagcctaagaacaagaagtgtgtttgtgggaggtaagtggagaagggaatttgggtaaaccgatctaagatatgggtggtccccatattaattacattttatcatttttattcttattttattatcattatcttttaagccacagggtctcgctgtgttgcctaggctggggtgtagcggctattcacaggcaccatcacagcaacccacagcctcaaactccgaattcctagcctcaagcaatcctctgacctcagccttctgggtagctagaactacaggcgtgtgtcatcatgtctggctttatcattattattgttcttgttactacaacacatattggctctactgtatttcagatattctcctttctcttattagtgtgtgtaatcttattgaagagaatgtacgtgttccattggattctcttgaaagtggttcaggctgggtgcagtggctcatgcttgtaatcctagcactttgggaggcagaggggagtggatggcttgagcccagaagttggagaccagcctgggcaacatsgcgaaaccacatctcaacaaaaacacaaaaaaattagctgggtgtggtggtgcgtgcctgtagtcccagctacttgggaggctgaggtgggagaattgtttgagcctaggaggttgaggctgcagtgagctgtgattgcaccactgygytccagcctgggtgaatgcagtgagtccagaaccagaccctgtctgggaaaaaaaaaaaagaagaaatagttaaatcrtcttccaactgacattttwaaatgtttgtggtgataatattattaattaaaatattcatcctaaggattaaatataatccttttttattccagagtcttccaccctgtttaaagatttcaagaagatggcaaaatcatcttacatttttcagacttcatcttcaaaactgccattaccaaacgattccgccacacatccttttagctacagggctgatacatccttctgtggcttggaratgaataggatgattccgtgtgtgtactgattcaagaacaagcaatgatgacccactaaagagtgaatgccatttagaatctagaaatgttcacaaggtaccccaaaactstgtagcttaaaccaacaataaatatgtattacctctggcagtttctgtgggtaaggaatttagaagcagcttatctgtgtgttcctgtctcaggtcccccacgaggttgtagtcaagatggcagccagcgctgcaatcatttgagggcttgactgaggctggagaatgtgcttcccaggtggcaggctcagatggctggcaagtttgtgctagtggctggtagaaggtttcagtttcttgccacacaggcctctccacagggttgcttaaataacctcaggacatggcagttggcttcctacagattaatttaccttttgaaaaatttcctgtagagatggagttttgctgtgttgcccaggstggtctcaaagtcctrgactcaagtgatccaccagcctcggcctaccaaagtgctgggattaccrgtgtgagccaccatacctggcccagagcgagtgatcgaagagagaccaaggtggaaatttccacgactttgatgayttcatcttggaatcacaccctatttcttttgcagtattctatttgttacacaggccagccatgaytcagagtaagaggggactcatacacaaggatttgaaactcaggacatgaaaatcactggaagccatcttggattttccctgtaggggctttctctgttttcagacaaataattacatggaatcaatttctgaagacacagatagagggaaacaaaagacaaagtagtaacatctattattatttgtttcttaattagaatatcatgagattcacaggtgatttatagaggactggatgaccagatgcagagaggagctaccatctccatgagagcttcggagacctgcagagacattgcatgacttgcctgcggaagttgtttgataggaattctcattggtttacagaaataatattggttagtgattggctatacatggtgtccagcacagggcattttgtggctgcttagtgtcagtctagagcccatgttgcaaggggctttaagaggtaattagctcaagcagagagtgagatgtgattgctgtcacattttttttttaagtttttttawttttatttttttttttttgagacagagtctcactctgtcgcccacgctggagtgcagtggcacaatgtccggctcactgcaagctccgcctcccaggttcaggccattctcctgcctcagtctcccgagtagctgggactacaggcgcccgccaccacgcccggctaattttttgtatttttagtacagacggkgtttcaccgtgttagccaggctggtctcgatctcctgacctcatggtccgcccgccttggcctcccaaagtgctgggattacaggcgtgagccactgcgtccagcctgctgtcacattttaaatattcctctgggcttgataatttaaaggagctyacattcctcagataaaatgttcattttctttctcaaacctaaacataatattaaccaccgctatattatcatttttagtaggaggatgagaagggctaaatcagacacaattacaaaaaactcttagcctactcatcaattactcatataagctgagtaacagcaattctaatttataactcctttataataatattaaatctactaatgaggctgggygcggtgactcatgcctgtaatcctagcactttgggaggtcgaggagggcagatcacttgaggtcaggagttcgagaccagcctggccaacatggtgaaacgcggtctctactaaaaatacaaaaattagctgggcgtggtggtgcacgcccgtaatcccagctactcaggaagctgaggcaggagaatcgcttgaacctgggaggcggaggttgcagtgagcygagattgcaccattgcactccagcctgtgggacaagagtgaaactccatctcaaaaaaaaaacccataaataaataaataaataaataataaatttacgaatgagaggagagtgaaaagtaccagttaggcagatagctaggacatgtccttggtagaattcctttctaacaaagaaacagcttgaaagatcaagctgcaagcacagatcagggggcaaggtccaccataaaaatgccttctgtgtaactaactaaggtcacagtctgagctgtcaaagtgtcagtcaaaatcttgggtttatatgtattttggagtctagtagttgaggtcaattactcacatgtgtggtctgatgaggtgtgacatactactyttgcagggaaggggaattacaatctatgttcttatcacagcaatacatgtatcactcaagtagcaaactatggaagtagaatcattttaaagctttaaaacagcacttttagcaggaaatttagcccagggaggagcctctgtagatcaaaccattttctcattacacttagcaggtatttcatcaatgttaggtgctactaatyttatcacaacaattattaatatacaaccacaaattatatctcartgtcaaaaatcatcatttatttgatctgcattaattacagctgtgcttttgctactttctcttccagttttagcattgatattactatacctgtgctattcaaaaacataaccttaatactgctgttttatcccacaaggagactcaattttatatcaatgttgtattctgattctttctcttgcagaagtttatgttgttattttactcagatgtagaagagtttcacatgtaacatattcggttaataggaatagtctaaaccatgatatctattggtttcttaagattcactgtataagcctgatacggtttggatatttgttccctccaaatgtcatggtgaaatgtgattcccaatgttggaggtggatcctaatggcgatatggctctgatgaatgraggaacaccagggtctttggtctcctgctgatttagataaaacaacacggaaacaccttgagtggttttaaggagtagagagtttaataggcaggaaagaaggaagaagctctcctgtacagagacagagggagtgaggctccaagggagaaacctcgtgtgtggtacggaagtagttggttatattaggaagctggaggaggaggtgtctgatttgcatagggcccaagggattggtttgaccaggtgtgtcattcacgtagaccacaaaaaaccctggcactcccaccttagccctttaayatccaaatgcaggccaccaagatgtcctgagcatgtgtgagttatctggaggtggctatgacacttggcacatgtggtgacaatgagaagagggtgggaattgccatgttggccatgttgggtggacctagtttctaatcactggcatttgcatatcaaacttgccggcctggtttttcaagctgcctgttagaaaagaaatggtttgggggttgcttctcatgacaggaaaatttccactgagaayttttaccctttctagtggcctaamaattatttcctaataactcctgtattattccctgcctcaagagaagtaaacctaactgctgttaaggggtgttggaygacaattctttctggctacttcctgttgaaaaggctcgtcacgtgagggacagcagttggtyctcctcctgaggttgatctaagygttctaggaagaatggtgtgtccatgggtggctctgctcgcagcgttgtttggagtttgattgcttctaggtgaaaagagataaattttacaagaagatttaaaatatagggttagagtatgagtattaagatgaccaccattagagggaattctgtagaccataactgagtttgaaatctgttagttacaccaaagggttgcaataccggttttcgtccactagatgccgttgtacattaccagagactttatataaaagtaacattttccttgagaaaagcatacattttccttgagaaaagcatacattttccccttgacttcccattagagaataatttttggcataggccatttttgtgagttgcaatatgattgggagaaatatgatattgggtggctaaaataactttagcattaatcttggcaattcytttcctttaattagtaaattcttttgtgactttcacagaccctcttacaacatactcaaactctctgacttgtcctaaacatccttcctgtawacaaccagtcatttccttttaggacaagaatttaccatacacaatccttccttatataaaatctttctttataaacttcttttaatagtttagaatgcatcctattaccaactttcagtaaaaagtcatatcaaacttaatgatagtaaaacttttatactttcatgcttgctttttttctttttttgatatggagtttcgckcttgttgtccaagctggagcgcaatggcacgatctcagctcaccacaacctcctcctcccaggttcaagcaattctcctgcctcagcctcccgagtagctgggattacaggcatgcgccaccacacctgtctaattttgtattttttagtagagatggggtttcttcatgttggtcaggctggtctcgaactcccgacctcaggtgatccacctgcctcggcctcccaaagtgctgagattacaggcatgagccatcgcgcccggccttatgcttgcttcttatccataactatcactcctgctataagcaaaataaccttgactaaatctttcctgcaattattaatcctaagataaggaagataatcaggcaaaatattataacaattagaattttacaaccaaaattccgcattgtgggtgccacggtgtatagttccatcgcaaatagtggtgtaactataacatttcccacaagagtggcatagtaaataattttcgtttaartctttacttgcctagatataacatttccctttggggatctacaaagttacaaatgcaatcccatgtataattaaatctcgctgcaaatatgccttaaaaggaattttaatatttggtggcagattttgagaggaaaggcagaaataataaaaagtacccgatgaggtaggagtagccctcactcagttacttatcttttatgattttcagtttaagatcttctatttctccacattgatattcaggacgtgcctctgggctgtcagaggttgatccctcagctgttcaggctttgacttgaatgtggaagtcaggagttgattcctgtaacttttactgccaatggkgttgaaagaagaacagtgtagggcctttcccagcttggcttagggaaggagacagagatgagggttttcactaacacyaaatttcctgggttaaataaaggtggttctgtttcctggggttggacttctgttagttgcgttaattcttgttggaagtgagctagagaggttacatgcttaaccaatttagaggtttcctgcctgaaaacaatctctgagcacactgataagttttatcctttcccaagtgaaaagcttggtgaaggattttaaggacattggctggaggctggcaaatggagtttgccatcctctgactgtagcctttctgagggctgggaactacgtcctcragaagtggcctattttatttctgcagggaaatactgaggtttaatttttcttatggagccttcctagattagaaggggcttaagtgccttaacggcttgaggcttccttgcctctgacttaactgcctgatcagctaacctatttcctttggctacctcatttgttcccttttgatgttccttacaatgcattcctgctatttcttgtggaagaaaaactgaagataacctgctaatttcctggtgatatttttataggggatctattaatggtaagaaaatgtcttttctttctttctttctttttgagacgaagtctcgctccgtcgcccaggctggactgcagtggcgcgatctcggctcactgcaacctccacctcccaggttcacgccattctcgtgtctcagcctcccaggtaggtgggactacaggcgcctgccaccacgcctggctaattttttgtatttttagt

SEQ ID NO: 13293 - DNA, 645179 bp, Homo sapiens
catgtttatttaaacagatgcagaaaaagcatttaccaaaatttaatattattttgtcacagaaactctcaacaaaagaagagaattccctccactttgtactgagcatctrttgaaaacctggagccatcatcataacggtgaacgaatgttttttccctctgataagaaattaggcaaaaatgtccactcttaccatttctattcaactttttaactggaagtcacagccagaaccaaatagcaagaaaaagtgtaaaaagcatacagattggaaagatagaaataaaactgcctttatttttggatagcataatcctatatataataatcctaaagaatcaacatataaactacttacaagtgatttcaacaactttttaggatccgatgtatataacctatatcacttatattactatgaaaytaaatttatgaaaaaytaaattgaaaaatatttacaatagcactcaaaaacttgaaacacaagttaaattttagaaattatgttgacatgtacatgaatgggaagccaagttgggaggattgcttgagcccaggagtttgagactggccttggcaacatagtaagaccttgtctctcaaaaaaaaaaaaaaaaaaaattaattagctgggtatggtggcatatgcctatagttacagatactcagaaggctgaagtgggaggattgattgaacccaggaggttgacrctgcagtgagccatgactgtgccactgcactagagtctgggtcatatagcgagactcatctcaagaagaagcgcggtggctcacatctgtaatcccagcactttgggagaccgaggtgggtggatcacttgaggtcagaagttcaagaccagcctggccaacatgctgaaaacctgtctctactaaaaatacaaaaattaggtaagcctggtggcacacatttgtaatcccagctacttgggaggctgagacaagaggatagcttgaacctaggccagagtgagactctgtctcaaaaaaaaaaaaaaaaaaaaaaaagaaacccaaaagacatgtacattcaaaactataaggcactgcttagaatattaaacatgtaaataaatgaagacgggctatatttgtgaatggaagtctaaatattgctaagatatcaattatcccacaatttatctgtaggtccaacctcattacaatcatgttccctactctccttttttgggtagaaattaataagctgatatttaaaattatatggacttaagaaaactaaacatattcttaccatatgatccaggcaattgtgcttctgggtatttactcaaaggagttggaaacttgtgtccacacaaaaaccttcacatgtgaaatatgagaatagttataatctatagtgacaaaattagatcagcagttgcctttttctgggaatggaggttggrggatttattgcaaaaggtcagatgytgatagcagttgtatcaataattgtcaaaacttggaaccaaccaaggtgtttttcattagatgaatggatgagtaaactgtggtacttcaagataacgaaatattttttcagtgctaaaaagaaatgagctatcaagccatgaaaagaggaaacttaaatgcatattactaagtgaaagaaacttatctgaaaggctatatattgtatgattccaaatatatgaccttttggaaaaggtaaaactaaggggacagtaaaaagatcagtggttgccagtgtttggaggtggggacagggaggaggcatgaatacgtggagcacagaggaatctcagggcagtaaaattactctatatgatagtgtaatgttggatacatgtcattataaatttaatgtaattataaattacattaaamcctaatgtaaactatgaaatcggagtgataatgatatgtcaatgtaggttttcagttgtgacaaatatatcactctgatggggcatgttgataaagggggaggctatgaatgtgttgggtcagaggtatatggaaaatctctgtaccttctgctcaactttgttgtgaatctaaaacagctctaaacaatagtctattaaaatwaaaaaataaaatattcaacttcaccaatgaatagatttttacctaaatattacataatatgtgaagaacctaaaatagtaaagataattttgttttgtaaaacaacattataggatttaccttacctaactttgaggctcactgtaaagctacagtaatagagactgtgatagtggaataaggagatatatatatatatatatatatatatatgccattttatatatatatatatgccattatatatatatatatgccattatatatatatatgccattttatatatatatatatatatatatatatatgccaatgaaaagagagtccaaaaatagacccacacgtggtcaattgacttttgaaaaaagatccaaggtaattagacgaggaaattatatctttctcaacaaatgatgatgaagtgaatggatatctacatggaaaaagaaagcccttacctaagcctctacttcacagcaaacaccaaaatttgctggaaataaatcatagacccaactgtagaagctaagactataaaatctctagaaaaaaaataaagaagataatgttcacaactttggtgtaggcaatgatttctgaaagggacaaaaaatattaagcataatgaatgatttaataaattgtatttaatcagaattaaacacttctgctctttgaaagcactccaaatgcaaagtcaagccacagattgagaacaatacatattatagtaaatgtacttgacaaaggtcttttctctagaatatgtatttaaatcttattaataatctggcaaacaaagcaaaatgagcaaagatttsaagaagaatttcacaaaataagatatacaaatgacgattaagcacatgaaaatatgttcagcatcatcaaagaagtgcaaatgacaccaccaatgaggtatcaccacacaagcactagaatggctaaaatgtaacaatattagatgttaataaagccatagagcatctggaamtcctatatattgctgtgggaggaatgtaaaattataaaacaacattggaaaagaggttcacagttttgtatagcgctaattacatacctgataatataactcctaagacttgataggaatagagaaatataaacatgtccatgcgaacactgtgtttaaataatcatagcaattttattcttcatagccccaaactggaacaacccaaatgtactttaatagttgaatgtattaaaaaattgtgatatatccatacgatatagaatgatagatactatyagaatgatagaatattattcagagatgaaaaggaatgtattactgatataagcaacatgactatacctccaaaacatgttgcaaagtgaaagaagccagacacaaaagattactattttattattgtatttacatgaaatatgagaatagttataatctatagtgacaaaattagatcagcagttrcctttttctgggaatggaggttgggggatttattgcaaaaggtcagaaagaaaactttttgagattatagaaatagactatgtattgggyactttgtcagatgagtatttacatctaaaaaatgtttcaaatgagcatatttattgtgtgtaaattgtaccttatttaggtttatttggaaaaaatatagctctaaatatactggttcattttaatttgggttaaatatttaagaattttttccatgtgctgaatcaaacaagtagagttgacagtggagatcatagtcttattctcaaggcattttcatgtaaaataggaactcaggtaactgcagtaactgcagaaaagcaggtacaaatattgattataaaatcctgggaaaatgtaaagaggaaggggatagagggaacatggtatattttcattccacaattagagttagcagctgcatcattctgattttcctttttataaatattttttattatttattagattaactaatttgagttgaggccacaacatggttgagtaaaaataatcattttcctttttataaatattcaataaaacttttcctttttataaatattttttattatttattagattaactaatttgagttgaggccacaacgtggttgagtaaaaataatcattctgagaatagcaataggtttagaaggttaatttagggtgcctctctgctattagatgtacctgaaaaacacttctaggcaaaattagaccaaattaaaaacactggggcttcaattataataaaytctcaaatataagttttattattgkttattataataataaataatgtataagtgtgcagacatgggcagactacattttgcaaatttccacagtaaggtaaaaggattacaaagctttctggtataatattaacagaactaaaagacwtgaataatattaaagaatgggctttggctagtgattttcaatcaattctcttcaaagcaatactctcttaattttactgaaagaaaattcaactttaatataatatttagataaatcaatacatcttaactataaaaaagaaaactatctatataagacaatatgtatttcaacatataaatgcttgggtaaaacttccttaggaggcaaaataaaataaaagtttgcacctattcttagatgaccccagtgtaatcgatgggatgttgatattgtgctggtgactcaagtaccatgggcaaggttgttatcagtgatgtgcttctctgaaagtacatctttacacccattgacaaatgggtgtaaaatccaaaaacacaaagtaaattatcttctcaatgtatatagtagatgcatcctagaaaaaarcaaacaaacaaacaaaaamcacacacaaaaatttgatgtggaaacaaacttaaattaggtttcaaatataaggcaaggttttgttgttttgtttgtttgtttactcactacataaatgaccagtggcccattcagaagtctaaggrcaaaatatgttgtaggactgtcctgaccactgagggacagctcacaccctgacccaacagtacactaatgcctgcagtacccaccgttcccggagtaaaccaaaagacatcctgcgactcacaaaatccattatggagttgttttaaaccttatgagaaccactgacctaggccataaaaaacaaatgaaaaaacaacaaaaactaggaatggcagtagttctgttgagttaaagaggagaaagaggagaaaccaggactggaagagatraaattgtgagtctggaaggaaactattgcaaaggcctttattacctttaagtaaatgtctcctaactgaactgaaagccttcattctaaccattagtttggtcaggaacatttcagggacgccagggtggctgttttattttgcacttcctttactgccctcccagcagcctacctagcagtaagttccccagcctgcagtgtccccagagggcaccttccctcggctagtaacttctcagacactctggccttggggatgtcttggatcttctaggtacacartggctgcacacagttttgccaggcctttctcaagaggtaaaagttcctagctgtttgcatttcccagaaataatgttttccatgtgtagggattttacagatttcaaagtgctttcatgtcaattactttctttaatttaaaagaagttcagataccaggtcaagctaggaatgatccggtctcagagggaaggagcgctctaggaaaggaggatcctttaatagagggccgtcctggggccgcgtgcccatggaaggcgagagtggaggagtgtcctctttctcccccaccctcaggcggcggcccggccaaagccagagggggctgtctcctcctcttccccrgcagctgctgctcgctcagctcacaarccaaggccaggggacagggcggcagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcrtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacayacacacacacacacacacacacacacacayatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatmgtgaaatttctccttttgcttaaatacagaggagacttctatgtcatgtgtactttaaggccacagtgactagatatacactttggaggactttggaagatggctgtatttaatgtaacttaaataacttattctcctcagagmctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattrtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggyaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccayagaagaacatgacaaacaaccaggtttgaattttataatatggagaaaatagctcctctcctcacttcctccccatgccattttgagttgytcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgyatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaartaattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggrtggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcytatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccartgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttarraatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacwttctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagytcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttrcacctggaaagaattttacccatgtgtgatgttatagtatcattcatagatcatttggaagatactgatttactagttatgcagatcagccacaacttgacagattttcttataaaatattttaatyacattttttatgactattgatctcaccagaaaagtccctaaatattagaagctgttaatctcacaatggtagagacaaatttttcagaatttttattttcatttgtaagttyctgtagttattgacaaattttgttatttttcttgaaatagttactttattcattcttaagaaaatgtttatcaaacaaatgagtcttaaaaaccatagttagatcctttttgtagtacatagggtattccacraaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatrgccatatgaaggtaaattttgcwatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcrgtggctcacgcctgtaatcccagcactttgggaggccggggcgggtggatcacgaggtcaggagatcgagaccatcctggctaacatggtgaaaccctgtctctactaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatstatcctttgaccaaatttttcrctcttcaagggcctcatactgctctgatttcagatgtatagatatattgcttatcaaacactgatgggtctgarcatgagtggtagtaagatatttccagattaagtagacaaattgtgcagaaytttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgyagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcrcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcataggktagtcaargttgccactatcctggttatggatggtaatagaactgcctatttatttgatgtcttcacttagttgtctcctaggtccttcacagcgaacatttgccaggattkaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacrcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggayaagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctcyacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccytatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagagrcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgsagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccasttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacasatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcayttacaaatatttcttagggtattggctactgttggtttgaaatgagatamaacttatggattataaatatgtttgtgcaaattttctctagcagtaattctaaaacctttgtggacattaagctgtaattgtagctttctcttgcaagcttytttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcmccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagrgatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaayaaygtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacrtgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattcyatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccayatcctctccagcacctgttgtttcctgactttttaatgactgccattctractggtgtgagatggtatctcattgtggttttgatttgcatttctctgatggccagtgatgatgagcattttttcatstgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattygctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgakgatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttgtctattcagagattcaacttcttcctggtttagtcttgggagagtgtatgtgtcgaggaatttatccatttcttctagattttctagtttatttgygtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtrtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtyggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccawgtatgtggtcaattttggaataggtgtggtgtggtgctgaaaaaaatgtrtattctgttgatttggggtggagagttctgtagatgtctatcaggtccgcttggtgcmgagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggwtagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccrtgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttrgtgaatctgacaattatgtgtcttggagttgcttttctcgagaagtatctttgtggcsttctctgtatttcctgaatctgaacgttggcctgccttgctagattggggaagttctcctggataatatcctgcmrwgtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttyttggtgtggatgtcctttctgtttrttagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttctyagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcrgrcgcccctcccccagcctmgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactccctgaccccttgcgcttcccgagtgaggcaatgcctcaccctgcttcggctcacgcacggtgcgygcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttccyttatatgaaacaccaactaagtacttttttctgtctgccttctttcacccagtctactgtctgtaaaaatcattcatgtttttgcatccatcaatattttgctccttttaatcgctaacattttccgttgwatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaagrttttattttttacrtttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtggrctgtggagcatgggcraccagaaaggcagattaagttaaaacagggttgacaaattgggagaacacaggattaagggactggaatttaagtttagatttgctttaataaagaaaaatgttactttgtgrtgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattkatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctsttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagrgctcacttgtattatttaactgtgtaatcctctatctcatatatatgtaatacttkcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagwcctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaartccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaamcaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagmtagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttwaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgrcctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttctttttttttttttttttgagacaggctcttactccgttgcccaggctgaagtgcagtggcaggatcatggcttattgtgcccttgacatctcagtttcaagtgatmctcccacttcagcctcttcactagctgggactacaggctcttgccaccccacctggctaatttttctattttttttgtaaagatggtaytttgccatgttgctcagactgaactcctgggctcaaacaatcctccccacctcggcctcccatagtgctaggattataggcatgagccactgcacctggyttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatytccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaaygtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagktttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctyactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcrggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacrtgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccagtttcatccatggccctacaaagcacatgaactcatcattttttatggctgcatagtattccatggtgtatatgtgccacattttcttaatctagtctatctttgttggacatttgggttggttccaagtctttgctattgtgaaaaatgccacaataaacatacstgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttkttgatggggttgtttgtttttttcttgtaaatttgtttgagttcattgtagattctggatattagccctttgtcagatgagcaggttgcgaaaattttctcccattttgtyggttgcctgttcactctgmtggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagtttyagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagycacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctyygcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggwacacaagaatattttttgagagctmctatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagrggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctyctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatygagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcrttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcaytgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaamwgacwtgctttactcttagattgaatacgagttttrcaagccagtgcataattcgccatgctatagagmcagatgatcttcmagatggatgcstkagtgtagaatatatagatcagttccccccacccttcacacatgggcccmraatgtacrcggagcaggagcaagaaatacacgtccttgctatctttgttagtttaatccacrgagactttggagtctgcagttatacagcatcctagcctgtcctgactgatatgatcccttaactgatttttctactcaaagtctcttctccctccgattattctacatcactatcatattaatcttyctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtstaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcacwctttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagrattgttacttttaaactcttactttccackgggactgttattgtaaaatctgttcttattcttttaatttaactccattattttgttttaaatgtaatgattgttcattatatttttytccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaartttcactgtacaccctaaaaaaaaggagaaattgatatggaacatgartagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgaygatttaatatacatatacattgtgaaatgattaccacaaccaaattaattartaygtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtrtttgtttttctatgtgtggcttatctcacctagcacaatgcccttcaggcttatmcatgtcattgcaaatagcaggatttccttctcttttatggctgaataatattcctctatctccctctctccctctctttctgtgtgtgtgtgtgtgtgtgtgtgtgtgtgtgtskstgtgtstctgtgtrtgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttkgaagaatctctatgcttaatgctgttttccatagyggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaayatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttrtatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattctyattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttcyatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccmcaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgargaaggtaccttgcttccccttggccttctgccacggttgtaagcttcctgaggtctccscagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttartttatgttaggcacagcaagagwttaacaacaatagagcaattataacaatwtactataataagagttatgtgaatgttgtctctctcactccccctcaaaatatcttattgtattatactcmtctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcrtagcagtstctatgatccttttttatttctgttgcaatgtctcctctttartttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgwwtaactaatgttttatgaggtccttagagtgctagacactgtttgcatgaattattttatatgayctcaccacaaccttataaaaaagtttttattgtccgatgttttagacrgcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctscaacttttcatttctcttcaattccaactcagkttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacytgacttggagtttcataaggaatgcaacagcttccaattcatttactttctttttgcttaacaaagtatctgacacrtagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagackggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagaccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgyattccataaaggaagaagttaagagcaatgatgtggaataagcatggggcttttaagaacttgtctgaaaagaggatattctttggtcaatagttgaaaaaataaaataagscttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacakttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtrtcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtytcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacmgagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatrcaattaattgtgatatactgtctactggagatttgttctccaaaacctgacaatctartactttgtaggaactaatgtgtataatcttagggggcttagtggacagaaagttcattagccrttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagaggsatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccytcccctaacattggagattacatttcaatacgagatttgggtaggatcacacatcctatatcacttttggagaaagartggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactkattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaatacsaagttcaaccrtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgragtattttaactaccaggtttgcacgttgacttctttatgcttcatttggattttctgaggctttaacgttttccgtttttaagactaagctcaagggtcaactcttycatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagakcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagrgagacgataaatagctcagcaaggtttttagggaagcagaaatgactcagatttgaaatataggtgacagaattagccytaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaamctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaayattagtgtgaaattaggacatttgggaaatgtgattgatatgatttgcatgtttgcccycttcaaatcgcatgttgaaatggtattcccagtattggacgtggggactggtgggaggtgattggatcatggggacagatccctcatgaatggtgtagcaccatycccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaarcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagacyttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtakacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgagrtttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggrgagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaarctgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttragtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaawtactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctayatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggaytctcccctctctcttctaagctttcctctttgttgtctttattttcactagggttttctctgtaaggtgcctaaaatggctactagtagctacaggtttaggacctggtcyttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaayattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgkgtkaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttaytgatagwgtcctttaaatgttgagttcaagctaatttttcttaatcttcaaaaagtttagggatcaaattgtatcctgcasatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagayggctatcattttagctgttataaaacaggaaggaacatcatggagcattagattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtayagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcrttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgmatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtattttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctrtcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagmaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttrttttaaaggcagtaaaataatmtaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttrtattttaaaggagattaaatatattttcactgaatttaattgtatctaagtaatacctttcgaagagtcaaatratacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctraccctcacacatttctgcctacatcctgcaacatatacttaaaataaatatwtaatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacccttgaaaaaatgtagattccatgatcgtataaaatttttattactttaaaaacttttctaaattaataaattataaaaaattaatatattcaaagcaactagatgtatgcctaaacacctagaaaagtgcctggcgcatgttagaaattagaaagtatttcttatgaacagttttatgatttttcacattgaagttgaagagtcttgccaatttcccctatcttatatatgtgatcagatttttgcctctgtaaacttttaggattttatcttgaccccaaatgttctgtagtttgatcacaatatgacctgtgctatgaattttttgacccgggaaattcatacacctaacttaaggattttaatttttcattattaattatttaacaatgtgttatttatctatggaactcttctttgttagatattgaatttcatggattaatcccctagctttttgtctttggtttattttgattactctttttttttttttccytttttttttttgagacaaagtctcgctcttgtcccccaggctggagtgcaatggcatgatcttggctcactgcagcctctgcctcccaggttccagcgattctccggccttggccccaccccscccccgccgacccccatgagtagctgggatttcaggtgcctgccaccaaacccggctaatttttgtatttttagtagagatggggtttcaccatgtgggccaggctggtctggaacgcctgacctcgggtgatccacccgcctggtcctcccaaagtgctgggattacaggcgtgagccaccacgcccagccgatttctcttttcttttatttccttttctttatattctattgtttcccctggggagacctcctcacctttatcttacaacattttaaatattaccataatttaataattcttttgtgctttgagtagtcttttaaaaattaatatctcatcctgttcttgttttgtgcatgccatatgttttgctagttctccgagaatattgactcatttttgaagtttttaatattatttttgcctttgtttcctctgttttgttttctttcatgggagatacaaaatttctgggaaaattttgctgtccaataatgtttagctgagacactaaaattgttaaatctctgtatgtcacgaaagcatgttaactcaaatatgaacaaggtatcatttcattggaagactcccaaatatcctctcggtaggctatttttatggacaggtattttccaatctttgtctgctagcatttttgttgagaayggagtatgagctaaggatgagaataatcacactctacaatatgtagattttcactttttcatttttagtatgaattcttatcctcacccctcatccttcactgcatggtaattggacactttcttattaaatttccctagagaattgtattagggttctgtagagggacagaactaatatgatatatatatatatatatatatatatatatatatatatatatatatatatwagtttattaagtattaacttatacgactgcatatatatacatatatatatgtatatatcatgggagtttattaagtgttaacttactcgatcacaaggtcccacaataggctgtctgcaagctgaggagcaaggagagccagtctgggtcccaaaactgaagaacttggagtctgatgtttgaggacaggaagcatccagcaagggagaaagatgtagactgggaggctatgccagtctctccttttcacattttctgcctgctttatatttgctggcggctgattagattgtgcccaccagattaagggtgggtctgmctttcccagcccactgactcaaatgttaatttcctttggcaacaccctcacagatacacccacgatcaatactttgtattcttcaatccaatcaagttgacacttgtattaaccatcacaagaataaattcccagtggtctcttgccaggtcagcaatgggatagtaacgaggtttatagggttggcagggggatctggatacctaactaagattttgcagcctcaacacttactctagccttgtaaattatttggtacttaaaatttcagagacattctggggatcagcagctcaaataacacttcttgctgtggtttgctcctccccttggcagacacatcctatccccagcttcctctgctctgggctagtaccactcactccatccactttccttccatcctatattaatttgttgacacttcttttctgatgtcatcctctggaccatatatatatatatatatatatatatatatatatatatatatatatatatatacacacatacacacacacatacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtrgcttaagaggttctttaactgcatgactattgtgaggaggatacttatgagttgttcttcatttccatggggacaaggacaatgaaaatacagtataatacattcagagtgttattagaagktaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagabttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgrcaaggagagaggttaaaaccaggaagccatgccttttagctgacaaaacattcattgaaatgctatctgggtgaagcactgagaaaytaatcrtctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaaytgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacawatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataaytgggatttttccatttttattttmctcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggttttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaraactaaatttttttttaaagattctgttgaatasgtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattattttgagaaatgattcaattgttgtctcaatgctaaatattcataaaaactatccattcattaatcctttttaaactgaagtaattagaaaaagcaggtcaatgtgcaaagaaatgggcttttcttcatcaaatggttaattctttattaaatggttattctttaaaatgagcaaagatgagctcagcaaataaggtacttgtaataatgaaagtactatatgcaggaatactggctttttgtttttaatctgyaattrgttaattaaatttcattgtagatgtattgcataaaatacatttgaaaggcaccattcttcctcataatacagctagtgaaggtccaaatttcagtgactcaagtgtaggtgggaaaaagtcctcacaaactttacgcaaattgttagaaaagcttatgtaaacatgactactatgaatacagaccagggatgtgccccagagtcaatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttctaaaaggaaaagaaaacaaagaaatgtcttttacaaggcactaaagaaagacacaagggaacattcatatagattattttattaaatatttattgagcaaaatatttgtgccaggcactgttagattggcctcatgagctttgcatgggcacccacttgctatacatcaggcttggaaacatactcctgaccagcatttatgctagacatgatttatgtctcatactgtgctaagggggtgactaaaatytatattgaccaatacttgatgagtatatttgacagatgtttaaaagttaaccctgctcaaaaatgtaacgggatctttrctaatcaggatcataggtttgcatgggttcctaggaggaaaagaatgagtgggaccagtttatacaccaagcatcaaaggactccattctcaccctagggaaacacggattttactgctcaggggatgatgaaaattggattccgacttttacacctcagattatttctattaattacayctcagattatttctattacacctcagattattatctcagattattatctattacacctcagattatttctattattcagtcttagccgaagattcccagccccaggtccatcgttgctcaagggtaagatcacagacctagtgcctgcattatttcccttctgtgcaaatcgtgagggccaattttgctctctaaaaatttgcattaaacagaccaatcactagattccttctacagatcaaaatgcatttattcaatcaaacaaaagggaatccatgtgaggcaactaaggaagggctttccctccagtctggtgagcagtggctgtggctctgctggctctattttgtgaggtctttataaatgaccacaattaagctgtagatgtactcatgccctagatgtaaccatccgttctggggaatatggcttgataaacccattggtgtctaacacttattcatgtcactcattcattcattcatttattcaaacaaatatttttgagctcttatgaggtgccaggcactgttctaagcaatgggaaaacaggagtaaacaagtccccattcttatgatgtttttattttagaggggataggaagaaggagaaaaagccaatgaataaggaaagaaataaatcaacaagataatttcatawaatgctaaggatgggaagaaatgaaaacaggtgttggaatagatcatggggtgggagttaattgaaggggtagtcaagaaaggccctgctaaagaagtgttgggttggttagagcccagcaagggacttttcakctctggagrtgcttgtagagaaatgcagaggtcctaatatgggaatgaacatctcatgtagggtatagcttctcatgtttgaggaacagaaacaaggccctaaaggctctaatattgtgagccaggataagggcagccagggtaagggcagatgacatctggagacaggtaggggccaggtaggaccttgtactgtgtacgtaggaccttgtacatgtaggagtcagatcacgtgggaccttgtgcttcgtttgaattttattctaaatgttgggaattgattagatgattttaaaaataatactttcttaatactgtgtcactctgcctactctctgagaaacagatcataaggagacaagggttggaggcaagcaatgcttctacagaagactttggtaggttcggtttctataatttccaagctctgcaggagaccactacagcttcctcctcagttactcttatttacttatgggcccaaacccctgagcagttaaaatctggcatcaataacactatcaattctggctaacaccttggccagtgagaagggttaatataacaggagggaagatgacagacggaaaaccatttcttttacctcttttttggtctccacaggttgacaataacatgttgtaataatcacatgtatgcaatttaccagaagttttgaaatcttagattaccactaacattccaatttctaaagacagtggacatgaattcctgcagctctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttggataaaacaaaaaaattaaaactactgtaaaagtgaaagatactacatactttaggaacaactggtatttgtatgcaagtgggcctaaatctaatgttgtgtgaagatcaaagccaagtacaattgtagctcatgttgcagttatttcgaggtctcaaaagggataacaacaaaaatctataatagaaaacagaatctgggttaaaatcagtggaaataatttttatttcagaattaaataaattgagtgaaatgaagtatctggctcttggaggaaaatatggtatcttattctttaaatgtctttaaatttataagtcataagctgcaagtcagtagcatcattatgttgatgaattacccagtttaattcttataaaaattgaaattatcttctgaactctaagtcatattttagccacaggtatttttttgttttgtttaatcaataattcctgaaagaatgaaacttattcgacttttattacgtgacaaggtttaaaaaaatttgcttgaataaaacattatggagtctgaattcaaagcataaaggcagaaagtaaagtatgaagatctttcaaacgtctgtcacttttaataattttgttctatgttatatgacctacgaatgttaagagtctgtaagagtttcttcagctgcatttgattttaccaacaycttgtgggtacagttaagaagatgacttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgrgaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagattttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcagraggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacartttattaattaagaacactagatttcaagtyaaacagacctgaccttaaaccttgaccttgttctttgctgtataaatggttttgtatgagttacttaaccacactgagcctcaaattcccatcagttatatgtggattataatgtctgcctcatgcttrttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgaygggactagagtcaggatgaggtggatgaaatgccaggtactttcatctgtatgacttgagagtgtatgcatcaaattttgcaccctcgagcacctctctcacctccacattraaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacaytgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaasagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgarcytgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggygcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcrtgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatrtgaagtaattaaagggatttaggataatggcctgaactaagawrgtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgagaaatgtatctggggggccttaaaatctgtaaatatcataaatatcatacgaatcctaagaarttctgggatttaaggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactachgtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttcttttttatttttaatttctttgccacctcttcttaatacataatgctctttcttccttcgttcctccccctctctstttcttccttcctcctttctttcttgctttcttctttcttttctttattctttctttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactsttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttctttyttttttttttttttgagagcatggtgtggtctcggctcactgcaacattcgcctcccgggttcaagcgattcacttgcctcagcctcctgagtagctgggattacaggcgcctgccaccaagcygggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaratgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctrwagttgcaaagtattgagttttgtgctcaagctryagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacayttggtgtgcattttagaatatcttgctggttcccagtaaatatgtcaactttttgcactatatrccgcttgaaatgtcaatactgcacaaataygcgtagtctgctgacagtaacctgccaggttctagacttccatattgattactgttagcaaaatgtgtaggtgaaatttttgtagggtaygcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagtwggagtagatattttaattttttcttgcttcttgagaactactatcaacaataaaaaaagctttgattttaacgtgtatatcttaagatttcttttgatcaatactaatgaaaataaacctgaaamgcgaatcaytggacaaatgtgagatttttcctttaatttatacattaattgatgtaagatagtatttagaaagtttcartcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaaytgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacaycatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgagrtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctasttttctgcctgtcttagaggcaaacaccaacacaggtttgttgtcaatttccttcccattaaaaatacttttacatacctactgtgtatctatagccaacagatcttatatttatgtggtgtttgcrtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatctcctaatgctatccctcccccctccccccaccccaccccacaacagtccccagagtgtgatgttccccttcttgtgtccatgtgttctcattgttcaattcccacctatgagtgagaacatgcggtgtttggttttttgtccttgtgatagtttactgagaatgatgatttccagtatcgtccatgtccctacaaaggacaggaactcatcattttttatggctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttgrtttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaarctgaatttcagggatttggatcaggtcaaggtatgttatgcacataaaccaaatattaatgrtatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttygcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgattttttttttttttgcaatgggaagagagatttctcactagtcttactggttttcatctgactttatagtttaaaattgatagccattttgatggcaacacacatggtttagttaaattttactccgtcctcagttttcctgagggagtrtcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccaytgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcrgtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcaygtgtcttttgctttttgtcattgcatctttaggatagtttgtttttttttkttkgttttttttttttttttgaggcagagtctctctctgtcacccaggctggagtgcagtggcaggatctcagctcactgyaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacargtcagccaacttttttcatctgctccacagatctgtggtaasgattaaatgagatgacatccatgaaacatatgacagaataccttgccatagtggctactcagcatgtaagttttttgtttgtttctttgagacagagtctccctctgtcrccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacwtacaaggggacatctcttatggactggtaattttaggattgtcyacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactmaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagkgcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacatagaaaatacatattattttaaaatgctttcttattctttattatgaccactattaaaaccaaacagaaaactgtagaactagccaaggtatcttacagagatatgtttcagaggagtgtttattagattctgttgtatacactatttgtttagctttttctgttttttaggtcctcggcctatgctattacagaaagaatattactctcttttgtatttactattggtttcctgagggaagcaattattttaattattgattatttatggtttaatggggaaccattgtattctaactcacaggaataaamcaataacaaataggatgcatgcaaaatatctcataaatgtgtacctaacaaataaaacatacatcttcaaatacgaatatgcatttagagcctrgcttgctgtctgaggtcttaacttgttctgtgcttcaactccctattataatggatgctacacatggaagctcttgggtcaccattggaggtaatagcgccctatagagttttgtgtctgggaagaagtggactttgtagttaggygattaaatatttaccagcttgccttaagccaagtacatgttaaaggactattttgtattattattttgtttttaaataggcccctttctctcatatttatcttgccttaattagggagtttattgtttattaaaaagctttaatctgaactactttcattgtgtgggtgtgtgtgtgtgctgtttgaaacaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggattttkattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtraatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttrgtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtcyagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttayagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaycagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacaytgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggtygacagtcgtggtatatgagagaaaatatgtagcctttgatgtaaraagattgtttttaaaaaaacataaactktacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgyrgaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcrttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccwtatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttstgtcgggcaattttagataaaatggygagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagaytggataaagaaaatgtggcacatatacaccatggaacactaggcasccgtgaaaaaggatgagttcatgtcctttgcagggacatggatgaagctggaaaccatcattctcagcaaactamcagaggaacagaaaaccaaacactgcatgttctcactcataagtgggtgttgaacagtgagaacatatggacggacacagggaggagaacatcacacactggggcctgttgggggaggggtgggaggcaaggggagggatagcattaggagaaatacctaatgtagatgatgggttgatggctgcagcaaaccaccatggcacatgtattcctatgtaacaaacctgcacattttgcacatgtatcccagaacttaaagtagaaagaaagaaagagaaaagaagaaagaaagaaacaaagagagagagagaaagaaagagaaagaaagaaagaaagaacgaaagaaagaaagaaagagagagagagaaaggaagagagggagggagggaggggatggccaatgtgactagagtgaagtaagagaggggaagaatagtattagtcaaagttgaaattgaagacacaaactggctattcaagactttatgcctgtgatgtggccaggcatggtggctcacacctgtaattccagcactttcggaggctgaggcaggtggatcacttgaggtcaggggttccagaccagcctggcaaacatggtgaaaccctgtctctaccaaaaatgcaaaaattggccaggcatggtggcacatgcctatactcccagctactcgggaggctgaggtaggagaatcacttgaacctggaaggcagaggctgcagtgagccaagattgcaccattgcactccagcctggccaacagagcgagactctgtctcaaaagaaaaaaaaagtttatacctgtaatgagatgagaagttcagattttccagtgtgtgttgtataaatgaaggacccaattttctcagacagaagataaaaggagttgaggttcgtaacgaggtgattttaaggatggatcatagaatcatcaagccaggaaggagagagtgaaatcaaggagaaggtgatggataggagaaaggaccctgagttattataacagagtccaagagtcagagagctgcacagatggkgtgggatatgccaggtcaaggaaagggccatgggagtgggtgcctgatgcggagaggaggaaaagaggtcagcgaggaggtaaagagcctgggcacagkcatgttggtagattttacagttacataaggagaggtaggaaggaagatggcgaaccagaaagtaagtcattaataatggctggaaggtggttttatgagggatgtggattttcagagagaaagagaaaactgattaagaagtagcatcaaagaggagcaaagttgatgcacaacctatctctagatcttgaaggtcttatagaatattgtttctaagtcagaagtatgatgacagggggaggagccaagatggccgaataggaacagctccgctctacagctcccagtgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggyggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacrgcagtaacctctgcagacttaagtgtccctgtctgacagctttgaagagagcagtggttctcccagtacgcagctggagatctgagaatgggcagactgcctcctcaagtgggtccctgactcctgacccccgagcagcctaactgggaggcaccccccagcaggggcacactgacayctcacacggcagggtattccaacagacctgcagctgagggtcctgtctgttagaaggaaaactaacaaccagaaaggacatmtacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatgaaaccaagttggaaaacactctgcaggatattatccaggagaacttccccaatctagcaaggcaggccaacgttcagattcaggaaatacagakaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacaaactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagarattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacsacataccagaatctctgggacgcattcaaagcagtgtgtagagggaaatttatagcactaaatgcctacaagagaaagcaggaaagatccaaaattgacaccctaacwtcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatrccctctctcaccgctcctattcaacatagtgttggaagttctggccagggcaatcaggcaggagaaggaaataaagggtattcaattaggaaaagaggaagtcaaattgtccctgtttgcagacgacatgattgtttatctaraaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcayaattgcttcaaagagaataaaatacctargaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactastttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcraaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcaggstttttattataaaataatatcaaagaaaacctgctttttaaaaaaatatcttgatacttgtattttaccaaattcatgggtatagataactttttgatttctcattactttcaagtatcttcttcwtgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctytggggtgtacttgattcatcagatgatggagatcctgctggcgtttcatgcaacctgctatggtaygtgggctttattggcttcccagcagcgayactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgytattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaaygttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttarggaccacaaatacatattgtacccaggatgtagtgtacttactgcagygtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgwgatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctcygaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatgrtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagwctggctactgaaggggtttgtttaaaagatttaaaaatctcttcagagtcaaakatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatarggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattyttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtsctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccayatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactcsggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatacygtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcrtattacagtgattcctcaatgagcagctgaatttccacctgttcttgacgtattacctatcaccatcaggctatgttatgaaactcacttttagagataaagcaaattrtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaarcccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaacttyagataaggcagttagagaaggaaaatcaaggatagattctagatttttgtcttgagcaactgcatggatggtgatgtcattgaatgtgatggaatagatcgggargggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtyatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattattaaagagcataattaaaagaaaaaatatgctatttaggtttggattactaattttaagtttaaatgcctttatatcatatttctttgaagctagacatgkattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatytagccttagagctttgaaatataactaagaaatctattaaaataaattaaatagaatatattccaaagtaactaatgttttcccatattaactcagaataactttgtctgaaattaaactgaatatatatcatttataratacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctstcctctccagtttatctgtgttatggattgtaagagtgttttgaaataatattttacttagtaaagtaatatccacaagcatttcaccatgaaaaacrttaarcattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaacygtgaggtacartatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctrtgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataatawtaggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctctttwgatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcaycgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaamgccattatttcatttattctatgaaagacaaaattggcattttaaaagtagaacacrgtcttttgatacctgtcatctgagataccyaaaggattttttttttaagttagcatcaagggtaaataataacaaatgaagttattttatgttagatcttrtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggraagattgatgagacttaktaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaaytcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaaccctggtctctactaaaagtaccaaaatcagccaggtgtggtggcaggcacctgtaatcccagctactcaggaggcygaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggyggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctccyttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaarttaaaataattacagaaaggtaaattattctgatgctaaaattagcctttcattgatttcaagtagattgtaattggctaggatcaaatacatgctttatgtaatacagtttatttcttaaactgatacagaaagtgcacrtaattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaakctttttctaacataactcacagctgtagacttttcctttcaataataagcaaaaacaattttcatagctacaaaccgccgacacaactttctattyaaagaggacttctttgcaggaggsagaataataactcaamaaaataaatagaatctctaatttcaaaatactattatccccaaaagtaatgggaattttaaaaattatttagtgtytccagtttagatatttaaraacaccactcacatctacatgccaaataaattgactccaccctccacccgttatatcagggccccactccatccattgtcttttttcttagttatatcttgatatgtcaccctattagttttttccttgcagcatttcacttgcttcttgcyttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtartccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctrtattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttcygccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttgktttggttttagagacgaggcaggtgaataggtatagactgaatgctcctaagctagatgataatgaccaaatgattactgagacagggatgagcgatggtcartgaaattgaaaggatattttagcagctgctttaacaagtatctgggaaaagtccggtctcttccttgcatttctgaacgttaatttgtattaaaagcagcaygactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttcttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagaygggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggyggagacaggaggaccctttgagcttaggagtctgaggttatagcacactatgmttatgcctatgaatagccactgcactccagcctgggcagtgtagcaagaccctatctctgaaaaaagaatcaaaggccttaaraaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatcactgggaaaagacacaattgaggttttataaaatgtaaaaaatcaaatgaactctgtacttycacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcamctttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtytgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggttkcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgatatggaatagaatgagaggttgtgtgaaattaaaatcatgatatcaattatctttctgtcatgcagaataaaataagtgttttgacagatataaaaaatatttatggtaattaagtacattcatactgtatcagctaaatttgtagaatattgatttctgtattaaattatgtaacattttaattaaaataaatatattgtcgagttgtgagcagcacagtggtaagaatattttgcatgaagatggttacataaatatgcactaaaattgagtctaactgcaaaaaaatgaatgcagtagctacacatttagaaagaagttctaagaataaagcagtttacaaacaaatagtatatatacatgtatatgctttgttagaagaaagagaatttattgtgagtgggatactttaamtctttcagatgttaaggattctatttcccaaataacttcattcatgtaagaagtatayttcatgtgagtcaggttttattctctaggtgttttctaatgtgggaaagtgaaatacaagggtttgaaatggttctggggatgcagtctttcctgtcagattccagcagatgctgatataatttaatattcgtggaagacagggcaaatatagaatagcatcaaattgattttgcagagttttcaagccagatgtcccttggcatttacatggaagaagtctactgtgtaccaagttgcatatttttgtgtgtaagttctcagccatggtatgtagtcattggtgttttgacagccatctgctcagacctttatttctctgttcagccataactaaaattgaacatttttcaaatgttccaggtagtttcaattttaagataacagaaaactagtattcaatggttaaaaaraaaaaaagcaatacctatctttggcttagtaataacccctaaattgaaagttaatttcttataaatagcagtgcaaaatgaacaaactttgagaacagaggcctcaccttattatcaaatgagtttgttttaatcatgtggaaggctctcagctagacactgaggaagttatagaaatgggtaattccaaggtgaatgttccaaggatagctatgtcttatacataacaagcacttcatcattatttgctgaatgaatgcrtatgttagaatccatatgtaatagcttgtccatttgcacatattttcaccccactgatagtttttaatatgtggaggtacacatacatatctctgtgttttttgtgggtgagatatgtaggctaacatgtcgtaagtgaatgaaactgtgtttgataagaactgtcaagtgttgactatgcacctattggtgtgctagacattctgaagattcagaagaagtatacaacattatttctaatgttatgattacatctacagacaaagaatcaaacaatgattctttttaatggtaacttgtgttttttaatgttaaagatatgggccaaatgataaagaacaggaaaagatgagtttttttctctatcagaaggatagattttgagctaatcttgaaagaaatactaaatttagacttatggagaataatttaggaaagcaattgaacactacccaggggaggtgggaagtgagatgctgtgttcagagtgagataaggaaataatttgaccagagcatgggattttaattgagaatattaagagataaaattataataaatgtagggaaggtgtatcagagtgagattatgrtatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtayatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtactttttttgggtccagcattacattaggcagatatattattcagcaagttttcaayttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccagkcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgaygctaaaacaagatgatgaagaaattactctgtgtgcaagtgtggagaaaaatagcttgtgataccatagtgatcttagagctcattatacatcagcaatgaagagctttaacwaccatgcaattaaaatactaragagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagrttggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactrtgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtcaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatayactaaagctgcatrgaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcrtgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaraagcagagctttattctagaatcggactaaaggcagtattckttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttktctaagtcttttaagccagagaaaacataatgtgraacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagrgtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagkgtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcytccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaaacacacaaatgtaggtgtctttttgatatagttagttcttttcctttgggtagatacccagtaatgggattgctatatcaaatagtagttctcttttttgttctttaagaactctccatattgatttccataggggttgaactaatttacattcccaccagcagcgtataagcattcccttttctctgcaacctcaccgatatctaatattttttgactttttaatactagctattctaatttgtatgacttggtatctcattgtggttttaatttgcatctccctgatgattagtgatactgagcattttttcatttgctttttggccacttrtatgtctttttcttttcttttcttttcttttttttttttttagaagtgtctgttaatttcctttgcccacttttaatggagctatttgtttttttcttgttgatttaagtttcttatagtttctggatattagtcatttgtcagatgcacagttagcaaatattttctgtcattctgcagttgtctgtttattttgttaattgtttattttgctgtgcaaacgccgtttagtttaattaagtcccatttgttcatttttttttttttttttgcatttgcttttgcaattagtcttagtcattaattctttacctaggccaatgtcgagaataatttttcctaggttttctttttatggtttcaggtcttgcatttaagtctttaattgatcttgagttaatttttgtatatggtgacacatagggtccagtttcattcttccgctagccagttattaaatagggtgtcctttccccattgcttatttttattgactttgtcgaagattagttgtaggaatatggatttatttttgcattctctattttgtctcattgccttatgygccatttttataccattaccatgctgttttagttactatagcctcatagtctcagagcatagtgtgaagtcaggtgatgtgatgcccccagcgttgatctttttgcttagaattgctttggttatttgggctcctttttgtttccatattaattttagaattgttttttctaatyctgtgaaaaatgacattggtaatttgatagggattgcactgaatctgtagattgttttgggtagcatagtcattttaatgatattgattctttctatccatgagcatggaatgtttttccatttgtccatgtcatttatgatttctttcctcagtgttttgaagaaatcataatcaattcctggtagagatcttttacctccttggttaaatgtattcctaggtatttcacttttaatagttattttcttatgtatgtctaaattttaatcacagcaaatttatggtgtaatcctatcttaattagatggatgatgtcctttgttgggaatttaataaaatctaatactgcttagctggaccaagtggataagatgacatttgaatccatagtggaccttgtagcccttcttttatttgggtatctactatatagagaaaacattggtattctataaacatgcctaagatccattggagtatgtatggttagctctgtttattttctttttggttacaataaaaatacttaacattttcactgtaacctgtttggaaggaagagagtaagcaattttaaaaattaattcaacagagaaacatgtactactttttctgattaaaaaaaaaaagaagaagaagaaaagagcccacagcagctcagaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcwggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgyatgttagttaaaaatataataatatgccaagtacggacaatgaagacagctactccacaatattcatttaatttaatttttttttttttttttgagacggagtctcgctctgtygcccaggctggatggagtgcagtggcgcgatctctgctcactgcaagctccgcctcccaggttcaygccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacackgtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcagrcatcaaggtcatccctaggttttgatacmtgtacagaatagtcattgcttactgctgccgccatcactactttctctttcattcctctgatatgactatctctactmctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgyccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaamatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagwtgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcwgtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatgkttcacrttcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtktgtgtggcggggagcggtgtgtgtagctgaatttgagrtagagacaaaaagtaattaaactggaagcagaaatcttagaatggggaaaagtmagrcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagatmaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagraggctacttgtctttccccagtgattttatgaatccattgaggagatctgcagaagtgttgtcactgctggagaaaaccaaggcttcrcttgcaaaaaggagtactttcttaaaaytgagaaatttggaaatatatcataggacttgtaaagctatgatggaagttagcccatgagtgtgtttacagaaggcagagctagatggcataagactcagggatgatgcaggaggtgataaatrtttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccrgttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttrgtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccrtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatktgaaggacttttatatttattaaaaactacctgttttctaaaagggttgtgctaatttacattcccaacagcaatgcagcagacttttgattgttytacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgwcttttatcatctccaattttctattaatcacatgtagtggatttttttttcattctagayactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttytgttgtcgcatcagttggttaacttgactgggctcaaagtcccaacttttttctttcctgtagagtgcagaacctaaaatctctgttyagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaacygatttttaaaaataaacagcaaaatagcaatgaaatttcatawagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctsgtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaargtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttawttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcycacaacacatggggattacaggcgctacaattcaagatgagatttgggtagggacacagccaaaccatatccaccattatgtwtattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgataygtttgttttttctttcttcattttccctaacagataaacttctatttctccttgaaaattcagcwcaagattacttcccatgataagcccatcttagtaatatttttattctcagatcctttactgtctggcataatatgtgctcaaaacatatttgatgaaggaatagttgtaccrttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacaytgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttkatcttttgaattcatttacctgtggaattttttggagtgattacaayaaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgytggtttcataaaacattgtagatgccattcagtagagtgattaagaggatagactctggagccagattgctttggttcaaatcatagctctgctacttgctagctgtaatcaggdgcgagttacttaacacctctctgccttcttaataaaatagagataatagtggtatgaagctcrtgtggatgtttygtgtagcaaatcattgtaggaacagtgtctgacaatagtgcttggcacattgcaaacattcaacgatgctggctattatgattataattattattattataygcagatgatacagacaaacatttatgagtccaatatttataatctaattattcgtttattttacaaatacattgagtrcctactctgtccctactatgtgccaagctttgaggataaggcagaaaatacaaattcaagatctagagatcttggtaaaaaaggcagaaaacacaaactcaagatctagggatctcagtaaaatatcaagccatgagatttagtcaggaaggtttcttttttcttttctttctttctttctttctttctttctttctttctttctttctttctttcyttccttccttccttccttccttccttycttccttyctttctttctttctytytctctctctctttctttctccttccttctttgcttccttccttcctttytctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatayaaaatatctgaaatggaagatggaagatttagtgrgatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaraatattttatctcaattgcttttaaaatgtatcaaaatcctaactttgtttctggtctacacaccttcatttgtccatctttttcaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctrtcatcattcattggtaatttmtgtgccagatattgtgcctgagatccaggaggaataaggtaggatatcgtctttgagctactgatatatagtgtggtaagtacaarggaaagaatgagcacagcgttctgcagaagagagaggatggccacaaaggcttggtgtaagtaaaggcttgccagaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgamagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcytctcttctcctcgcttacctctctctctctgtatatatatawwatatatataaaatatatatagcaggtagatatatacttatatgtaatctacataaaggtaaaaatatatattatttatatttatttatattatttttaatraacagatatattattttatttttattttgtttttgaggcagaatctcactctgtcacccaggctggagtgcagtggtgcgatctcagctcactgcaaccgccatctcccgggttcaagcrattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagakatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccagrggcatgaacggagttgtggggaggaggtgcgagtgtgtagatgtgtgtttaggatgggctgtgcagacggggagaattagagagataaaatatgtaaaaccataagtgtgtgtatatgtatrcaggtatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcytgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccrccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcrttgtgccttttttcttggagctggttaaagagaggcatgcatagtcccctcattatataatttaggaatgcagaaaacattastatatttcagcarttgacacttgtttgattaaaattagtggtcgtgtgtatcacagaatatcagaaaacatgttaagacaccaaagaaggcaaccaccagaaacctttcctattaatgactctggktaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaragtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaagrcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttstaaagtactcagcagattcatagtggcaagaggcacactgaagaggtaataaatgartgatgaagaagaagaggggactatagaaatattctgtcaagtatccttgatgtgaaagagaatgaaggacagaggaggttgtggagttgcaaaggttttcaaagayaagagacatttgagttggtttagatgcttgkggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagyggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattargcaagatgacaaagcctgatggagggaaactaccattggttcagggactggtggccttgaaaatttcatagagaatgtgagaaagcccaggggcatgaacggagttgtggggaggaggtgcgagtgtgtagaygtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatrcaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattatttwttattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattaycctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacytaagagccatgaatttgatttagaaatggggttgtatgtgtgtktttttctatcacatattaaacgcacaatctgtaaaaaagattcaggaggatgtttgggaaatgttttctgtgatatttatttttcttcagaagaagtgycaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcaccygccaccatgcctgtgctattttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgktttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcaytggtccgtggcaaagtaagaaaatgagaacaactttccacatttttcataaaaatagaaaggatacaatttaaataattgtcckccawtttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttcmttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacmggagtacagggaagctcacctccactttgtttacatttctatgggcaaatgtgccgwctttctagtgagatgtgaggaatttaagtgcccttactrcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcaygggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaaragggccagaggaaacttttcctcctggtgggatcagactgtaagtagatacgggagtatcagagtaaaacttatttcagcatttgctggtctccaagagcctttaatttaaaataatcagcataycagcatgctatattttcgggtattggtttctgakcctcaatatctcatagaatgaatttaacagsattttatgttaaaaccagatatatattggactccctacrtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttytgtattattttaatgtttgatattcacatgatggttgttttaaccrtttttttttactttaaagaaaaagctataaactagttatatgatcttttcttcttcctttcatatgatgctgctaactcaatagagagmcacccgattacaaatgctattgatggaaagaacacttggtggcagagtcccagtattaagaatggaatcgaataccattatgtgacaattacmctggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagytgagaaagttktgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacacyatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggyggattgcacggtagacctgccttccacccatatgggcctcctcgggatatgaggaactggtggcggcaggggctcagtgctgcagcttatatcaccaaayggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctsaacagcaatattatttacctgttatcaaacatggcagcawttttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcrttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttyataaattagtatcttaaacataacagaaacgattgcatttatttgattaaatcactatagattacagtgggtttttttttttttttttttacattttaacattcaagataagcactagaaaaaatascaatttgtttggaagaaagtagctacttattttataagtagattgttcttagatacrtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatcyagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagagggrggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaagrcactgcaagaaaagtacattacagatcaatatytttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggytgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtatgtctttttttttttttttttttttcttttttttttttttttgagacgcagtctcgctctgtcgcccaggctggagtgcagtggcgggatctcggctcactgcaagctccgcctcccrggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcrcccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctgaatagctaaagcaatcttgagcaaaaagaacaaagctggaagcatcacactatctgactttaaaatatactacaaagctgtagtaatcaaaacagtatgctgctawcttaaaaacagatacrtagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcaygccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttgtttaagtacaacagaatatagttaaaatcacagttctttacctgytttarttgtatataratttttaagatcatttgttcagtatcacaagtagaatctgtggttaattagaaaatatattttccctttaaawgaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcmcaacatataggaagcattcaatgygtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtrctaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaataycatgaaaatgtaaacattttggagacccagatcctatttcaaatagagtcaagatgactgccctagaaaatgcttcttgaagtcatggaataaattakatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgytacaaggagagggaagataatgactgggagagggtatgwggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgargcatattataaggataaagtgatgtgttataggcaaagagcatagcacactgctrcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactcttttgtaacagcttctttactcttctgttgttgkyatgatatcctccagattacttaratttttaaccaagaagtaaccttacttattactagtatgctctttccttaaaagcttttctgatttatgttattttaattatatcaatcttgttattatktacagtttttaattattttaataatttcaacctttctgcaactttccattttagatatgtctcattaatggcatatagtgaagttttgaygttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatsgatacctatgttattaatatttcagttcttttttcctaatatatttattaacgcctacaatttgcctctacrtagggctttagttgcctcctacaagtttgatatattgtatttttcattatcatttattttaaaatatattctaattttcatagtaaatttttctgtggcctctgagttatatagaagtgaartgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacrccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgygtccttcatttatcagaactttgtaatattttacctcagtcccacctccccatcagatttaattctatagttctcwtatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatccyatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgytggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttacygtccattctttctctccactctccctgagacttcagtcacatccctgctagacygtttgccgtgctcattatgtattctatggcttcttttcatttgtcttctcttcttttgaggtttctcagtctgtacattttctgggtgacctgttgtttggtataaataatcccttttttctgctggattcaatcttytattacatacatttactggatttttaatttttgtatttttattttttagktttagaatatccawttgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttsccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcartaaaagtaccctgagaggaaaatggctagcttaccttawtttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacartaattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgayatttgagctgagarttaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgwgataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacrtgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaaraagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatatawatatatataatatattatatataatatataatacatatataatatatcttatatatwttatatatatatattatatatatwatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacratgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagaytttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttataygtttatgggggcagtgagcgtatgggaaatctctgtattttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactctttgtcaaagattatctattttttttctcaactcatgcaatgtttaacactttggaccatattatcacttatggttagcctcttataatatggtatggctattttttwaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttstattttttattagttattgttgttaaatctcttactgtgcctattttataaattaaacttcatcaaagatgtgtgtgtatagaaaaatacattgtatatatgggcttcaygcattgaatgagggtcttaggatgtatccccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggyggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatwtaaatgtaacatatgaatacttgtgtctggaattacaatagacacatttttatctccagrgagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtrtatacccaaaggattataaatcatgctgctataaagacacatgcacacatatgtttattgtggcactattcacaakagcaaagacttggaaccaacccaaatgtccatcaatgatagactggwttaagaaaatgtggcacatatataccatggaatactatgtagccataaaaaatgaagagttcatgtcctttgtagggatatggatgaagctggaaaccatcattctcagcaaactatagcaaggacaggaaaccaaacwccgcatgttctcactcataggwgggaaacgaacaatgagaacacttggacacagggtgggtaacatcacacaccggggcctgttgtggggtggggtgaggggggagggatagcattaggagatacacctaatgtaaatgacgagttaatggatgcagcacaccaacatggcacatgtatacatatgtaacaaacctgcacattgtgcacatgtatcctataacttaaagcatamyaatawaaaaagaaacttaaaaaaaatgaaatgtccgtatattttcttgattttttccaaatgttttgaagaaagtttttgtattattaaatgctattcattggtcaatttaagtaatcttcttttaagaaatcattcagarattgtaggtccttgatcgtaattctttttgggtaatttcaattkcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctraaacaacttgctattaaaaaccatttatcagaaacttgtttaattaatatgtcaaatatctgggtttttaaatcatgtataacaatsaaaatattcctaaaaacatattgagaactttaacaaaacattttacagttggaatgaaattagtactggatgattggattaaaagccagtagaaattatatattatcctatttaaatgtaggactatataagttattggtaatcctttttcrtaattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacrtttggatttatttctgtctagttctcctctgctcacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaataratgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgtkcaaatttttctttaccactctatattaacacctaagttaaaggccggcacaataarcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacrtttctaaaatgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcacyatttgcagtaccattcttagactcactgcaggcataaaccctgggataaggaaaagttaagcctccrttcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattrcatggtgttctgttatccagtctttgccattcacatggactcagtttatagtgtctggttatgctactgaagatcttccygctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgaytgaatgctcacagcaggacacatggcattacagaaagtctccaaaattattcatccttttggggacaactataaccatgattttttgtgacactcataacctgttgaattggaaaaatattaatgttagaaatcygttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggamcatgagcagccaaacttgctaacagcaaaacrtatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtatmaaattcagaaaaattgggagaaaatacaaggagaagaatttgcagggtgattgttgtaagatttttatcatgtcctcttaaaaatggtagcttttcagaaacttktgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaaggraaagattattaggaattataacattgggacacacctttgtttaaaaagctctaattaacaagaaccacagcaggggcgcrcatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaartagaaaaggagtggtaaagtagtaaacagcagagggtacaggctactcttaagaaagtccctagagaaggataagaaaatggggcaatacataagcttggaaatagatgatgatatttcttttttttttaatttaattttatttatttatttwttttattaatcattcttgggtgtttctcrcagagggggatttggcagggtcayrggacaatagtggagggaaggtcagcagataaacawgtgaacaaaggtctctggttttcctaggcagaggaccctgcggccttccgcmgtgtttgtgtccctgggtacttgagatyagggagtsstgatgactcttaacgmgcatgctgccttmaagcatctgtttaacaaagcacatcttgyacsgcccttaatccattyaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggyggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacacactgcactccagcctgggcaacattgagcactgagtgaacgagactccrtctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcrtatttctgattgcctgtgattcacaccattgttgtactctgtgacagtttcmttgaaaggactgtcatgttccatgaggaactcagcctacctgctcttttaccagtagctggtgggaaagccatrctgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgcttygtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtrgaataattcattttccaatgtgttaacttctcatgagtttaatgtgagtataaaaagtctgttttaactgagrgcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccrgaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgyactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttcyggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggattttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttacccygagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatmcaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccamtagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccrttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctgrcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagkgtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgtttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccamacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgakatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctggktcattttctttttttctttctttcttttttttttttttttgagaccgagtctcgctctgtcacccaggytggagtgcagtggcgccatctcagctcactgtaacctccgcctcccgggttcccgggttcaagtggttctcctgcctcagcctcctgagtagctgggattacaggcgcgtgccaccatgtccacttgatttttgtgttttcagtacagacagggtttcaccatgttggtcaggatggtctcgatctcttgacctcatgatctgcccaccttggcctcccaaagtgctaggattacaggcatgagccactgtgcccagcctggttcattttcaaatagaagttgtttctcattttacattgaaattttatatttatagtaaaattttaatttaataatatgatttattctaaaattttcaatattctatttttaatctccttgagcataaagtaaaaattatctttaaaagtttttgtctgataattctaatatatggcctttttggatatattttattttctgtttcatctgctgattctttttatgctgtcttacattcttgtgtgcctgattatctttgtataacagaagttgtatttgaaagagaatgtgtagaaataatttgagagctagtatattgtcttcatcctgtgtgaactttctgatgctactgccaggcaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtrtgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtrtatatattttagatagatttttaacgtggacagcagtatctaaatatttactgtgatttgtaatgtatatttttyactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaatmggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagctyattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatgatttcctttccttcttaccaccaccttctcactctcctggactgcagctcaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtgrtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttayattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccrgagaaactgaatgagaatggaatcctgaggagaaaacaccaatatttaagagacctggttctctcagtgttgtggaacaggatccactgakatggaacagaagggtaagcttctgttaagctaggtaaggaagcttagggttgtgaaagaaggtacaaagacactgcacactgacttytggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccargtagacaaaaataataataaaaccacaacaataataataataayaaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgktagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccrcccctctacacaccccacccattcracccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagartttaagcctttcagttaaaatatgaytcccaagcaaaaggaagaggattaatggattaactrttgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttrtgattacactttataagcaaacttaaaaagatatcaggagctgctttactaggcccctgcyatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaagggggraatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacaygtgtagatgttcattgtatctggagtgacagttgacaccttttaggggcattttacatgttttaaaacctgacatccacttacagcacttatctactactctcttcaggataaactacctttattgcaagacttttgctaaaaattcttagattaygtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcrttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacataraaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgkgagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtastctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtrataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggatkatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatcyaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccrttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttrttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcawaagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttayagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgwacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcraagctgggaccctagtggtrttgatgggctgttgctccttatccatgatgygtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactscaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactsctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaasaagttttacaatatttactaaagattacgattagtataccacaaaacatctgaactttagatattatttatrtgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttytagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtscacgyctgtaatcccagctacttgggaggctgaggcagaagaattgtgtgaaccgggcaggcagaggttgcagtgaactgagatggtgccactgcacttcagcctgagcgatagagtaagactctgtctcaraaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgtttgacaaattgaaatgctarttatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaartgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgttwctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagwggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtaragacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttscttttacagagctaggccaggggctgtatttagagtaattgaacacatgattttacttgaatgcggagaaacttgaccaactgtgaatatgcaatttcactctacagatgaaataaaattaaayggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtwattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactrttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatataytcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatgataatacacttagtacaaactgagcttcaatgggattactaratgagtatgtgaggacagagcagaggaaaaggccaagggttgagcactgtggtgctctattatgagaaagttaggaaggattaaagttggcastgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagyctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggmacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttstctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgtygagagattcctcattcttttttatggttgcagataattcattatgcagwtatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatcygtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacarcctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattrttaaattatttttcatattgtgtagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaayttttattttagaattgtagattattattattattattatttgaaatttgacagactttcctttgttcagatccaagctgtgccrcttattayatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcraataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtytaccttctmccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatccyactaaggtaagaccacygtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataacttyatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctrtartcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggwgtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgaragagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccasgtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtacyatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccrtagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccrtattcttgaaggttacagacagagcggggtaggctgcagcctrcagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtstgtatcactccgttttcacactgctgtaaagatactacccgagactgggtaatttataaaggaaagaggtttagttgactcacccttbtgcatggctaggaggcctcaggaaacttatgatcaaaggggaagagggagcaggcacatcttacatggtacaggagagagaggagaaagtgaatggggaagagccccttataaaaccatcagatcttgtamgaactcactcactatcatgaggacagcatgggggagctgcccccttgatccagtctcctccctccctccatacgtggagattacaatttcaaatgagatttgggtggggacacagagccaaaccatatcactgtctttcwgaagaaaaaaaaggaattcttgtatgttgccctaaagatataaaactgcttacartgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatayttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataakaattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggakcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtggaatacaaacgaactgaatgtctcaggtaaaaggcaaagtctatttctccaactctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagttgtccatatataaagaatgaagtgtttagaagttcccagcttgtatcctaataagagtactgaaaggtttaatattagcagcctgtgaacacgtagtgaagagagagtctgagaaccaagttaacatccttattccactctaattccacccatgccatgggtaaaaacagttcttgcagtctagagtttctcctccgatggtttaaccgtcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttataatatggcaattggtagtcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccagrtcagcaatgcagcaactcccatttttcttgatgaggatgtttttgctctttaggtctcgatgagcaattgcgggctttccttgggtgccatamrtttctgtgtgcaggtggcacagaccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatsgaatgctgccatcaaaaaayggacctatgacaacagggggcatgtgggttgcaaatactggttacataaattggtccgacaacrttctattgtccggcgtagctrggcttttggagaatctttgcactgaaaatcagatccttcatatttcatacaccctgaagctaatgtggtttctccctggtcatcttmttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttcygattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataayttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctattwgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacawttaggaaattttaggctattttttttatttttacttattttttttaggcttttgtttaaaacctgttttttgaccagtgtttttccttctctttctaggactccarctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcrggcaagtcrcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttcyttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggrcagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacrtatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaagrtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgtyattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagmcttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttargtacaattcttgttacctgctttctttataaaactgtaggattatcaatctgagcattacatgtagactaaattttgaaatattaaaaaacggatacgttwtgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccartctatcattgttggacatttgggttggttccaagtctttgctattgtgrataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcwgtatgataytggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatkttagtttgtatttctgtgggatccgtggtgatatcccctttatcattttttattgcwtctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacrtgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcrttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatygcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagakgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgwtaatgacctaccttatataggacctagaattttttgttgttcttctgtaaaaccatgctycctgaactgtagtctagtcatcagaatttgccagtcaactccaggaaagacattgttttaaagaatgacgtaagctttctagaagtcaattttgtagtttctcatctccaaggggtttctttatttcttgccagcgcaacrattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccrgggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttayttcctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagcctkagataatttctgctttgataattgagtattttttatagtcaatcacaaactatggtaaatatttagttatataccacataatatgtaatttgatattattagattattcaaattttctgttttttcttacttcatytgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaactttyctttattgatatatatmaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcwagggttttattctgaatttttaaataatcttctaaagtttgaacccagataagccttaaaatactcattatattcaaatttttctgttcaattataaaaaagtacaaagccytaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttgrtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttartgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattayttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactcmctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatrtgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctastatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagwtcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatatraaatataaatattttgttacctctaggttgcatgggtaatgcatgttatrtgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttraaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctcmagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtrgaatttttggcataaaaggttcatgcrtgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctcyacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtwagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcrtctgtacataaaatatatctggagtattaaagtttcatggtggggatgattatgaaaaaatgactatataggctccatagggacatgatrataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccaytgaagtatagataaacaaaaaaagaaaaaaattaattatatgttaataactttttaaaattcatcagtacaaataarttatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctyacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatatamttatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacraataatataaagaataaagcaacgataagaaataatgagcagagcatttattaataatttgatattgataacagaggaagttaaattattcaaagagctcaaccataaagcagatggcttcactttcaagctgggaatcaaaaaactttaagtsctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatcctwccctgtttttcattatatggtcagctttcactggcctgagtccacattttaagctcaactatatacaaataatttttcagwatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactytacactcaacctacatgaagatcaacatagtcacttttacgagagtagatttgcatccatccaataatctttctcaccagtgtaattagaaaggatacagcttaacacatagcttttgagcagatttttaaaaatatcattatacrttaaatatagttgagagggtaaaatgaagaatgtacagttaatattttccttatacagacatggacgcagctcataatgttgaaggatacctctgttgctgatacatctctttatttgcaggaaaatgttgaaggaggagactgyagtcgttgcaaatccggcttcttcaatttgcaagaggataaytggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaaygtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagasgtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggycgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttytctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcartgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggastctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctattwttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctargtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctcyctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttrtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaayagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacrcaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaaragaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaasccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcrcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaasaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcaytgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcackagtgctagctgtcacaagacctctagccagtcatgttttcagctgtagggcctaacaccatggttaaggaatggwtacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgmggctcagkggggaactatctgkatccagtggattgttggttctgacacactagcctacgtgcatatsgggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcckccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaataccygcagagtgttttagactttattttgaaggtgccaaattagagctaacatgcatcgcttcatgtcttcccaagaaaattacatgacaaatatctatctctgcttcactgacaacctrgcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatayayayayacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggragggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactrgaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttrgaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaarkaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaracaaacaaaataaaggattcaaatgggtgacatggccagtcctggttacagtatgagacagatgccggttacggtgggcaacagaacwgatgctggctacagtggtcgacagagttcattttagttcaagcagaaggtagggctggtgcttgttacagtggccagtaggcctggtttctggttatagcacatggcagagttaggagctctacctacattatgtccccacggcctcrtctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatrtttctaatcaccctatcccccagctctggctgagttaggccttctctgcacaattcccatgaaagcacctaccacccagcaggcagaaatatcsctctttgactttctcactaaactgcaaattcctggtgagtgacaactggattctattcttcttctaacctctagaacctagcagattgctttggagacsttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttktccagccctcaaattttatgagcctgagttgcattgtgtgggtaaaagtcttgtgctctgtggatcagraggaagttagatsttttggatatttacatagaaacaaagaayttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccrtggaatggaatgtggaaactgagaccctgaaagattaagtcacttgaacaaagatatacagcttctccagagaccaggcagacactaggtttatgatttcctgacttccactgcagatctcttaccatttttctatgagagwcataaaaaaagaatcagctatttactttctagtcaaggtgggttaaaatcaagccacttgttttcaaacatcgatttcgggttcatgccatcaaattaaaaaattcrcttaactgagtttaatttgctttcacttaggaagcagctgcctttcaakataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacwttgctttggaagcacatattttctgatagacatattactstcataatctaaaatttttcagaagtgacaaaagtggggttgaccattttcttcttcgctgtctccatgattttgctttttccaagatgtcatgtagttagaatcatacaatgtgttgtcttttcaggytggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacrcttatgtgataartcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagrtatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagrtgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctsaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtgratattwactcagtaaataataaagaaaactaatatgaagtrcaatttgtaatattctayttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaawaawwaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacrtgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatmttttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgytcattttctatatgttayattgaaaaaagtaatatggaaatgtaatgttttcatttgcagatgcttaaatttagatacatgtttaatactgtaatcattttgatcaaacagcagctatyatttattattcaatatttatatgtaaaacctgaaactttcatctaccttaatgatggtattgtgataaaagtacccatgtatcaccaagmtttgccaattctttttattccttaaagaatatcygacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatrcagccaaaaaacacatgaaaaaatgctcaccatcactggccatcagagaaatgcaaatcaaaaccacaatgagataccatctcacaccarttagaatggcagtcattaaaaagtcaggaaacaacagatgctggagaggatgtggagaaataggaacacttttacactgttggtgggactgtaaactagttyaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaamatgtggcacatatacaccatggaatactatgcagccataaaaaatgatgagttcatgtcctttgtagggacatggatgaaattggaaatcatcattctcagtaaactatcacaaggacaaaaaamcaaacaccrcatgttctcactcataggtgggaattgaacaatgagaacacatggacacaggaaggggaacatcacactctggggactgttgtggggtgggggggaggggggagagatascattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacrgaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggmgggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcrcaccactgcactccagcctgggagacagagcaagactccatctcaaaaaaaaaaawtaaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggcmaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaakagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctraaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccmtacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgcygcaataaacatacatgtgcatgtgtctttatagcagcatgatttataatcctttgggtatatacccagtaatgggatgactgggtcaaatggtatttctakttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgccwgttcactctgatggtagtttcttttgctgtgcagaagctctttagtttaattagatcccatttgtcaactttggcttttgttgccmttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctwttctgttccattgatctayatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttstttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccrkggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagttwatttgcatagaggtgtttatagtattctytgatggtagtttgtatttctgtgggatcggtggtgatatcccctttatcattttttattgcatctatttsattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgartgtgtttgctcttgcttctctagttcttttaattgtgatgttagggtgtcaattttggatctttcctgctttctcttgtgggcatttartgctataaatttccctctacacactgctttaaatgtgtcccagagattctggtatgttgtatctttgttctcattagtttcaaagaacatctttattccagmcttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttscttggtagatcttcctccatccctttattttgagcctgtgtgtgtctctgcacatgagatgggtctcttgaatacagcacactgatgggtcttgagtctttatccaatttgccagtctgtgtcttttaattrgagcatttagcccatttacrtttaaggttaatattatgtgtgaatrtgatcctgtcatkatgatgttagctggttattttgctcgttagttgtttcagtttcttcctagcatcgatggtctttacaatttggcatgtttttgcagtggctggtactggttgttcctttccatgtttagcrcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttcyggcttgtagagtttctgccgagcgatctgctgttagtctgatgggcttccctttgagggtaamccgacctttctctctggctgcccttaacattttttccttcatttcaactttggtgaatctgacaattatgtgtcttgaagttgctcttctygaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcargtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggarcttcattcctttggaggaggagaggcgctctgatttttagagttttcagcttctctgctctgttttttccccatctttrtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcrtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctccyggtgtgccgtttgctaagaccattggaaaagcgtggtattagggtgggagtgacscgattttccaggtgccgtctgtcacagcttcccttggctaggaaagggaatttcctgaccccttgtgcttcccrggtgaggtgatgcctcgccctgctttggctgacacttgatgggctgcaaccactgtcctgcacccactgtcagacaagccccagtgaggtgamcctggtacctcaattggaaatgtggaartcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagrggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgamgcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaarttatgtgggtatctggagcaagagcatcttaggacaaagagaaartaagtgaaaaggccctaagatatgaatgtggctggcatgttcaaagaccctcaaggatggggtaagagtggggaagagttgaaggatatggggaaggggaaaatatcgtaggyctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacrggagatcatgaactcagcttagctaattatataaagttagagatgcctattatatatcgaggtgtaaatgttaaagtgatagctagtatacaagtctgaagttcattkggtcaggaacatctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtakccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattrgtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcratatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccagrtgttatwatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcattkctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttktgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggatmaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaarcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcrtaataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctartaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctrcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaargtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgrgttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtkwgagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaacwataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagctwaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaagrtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacartactttgcatacttcartcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcarctactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttayaaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtgrggagttttatgtttattttctcatttcatcctaagagcaaacttcrgaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagataygtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacasgttatcttatcaggttaaactgattgtagtggtcacattgaaaaagaaaaaaaaaatcccaaattcaggacttttcccaaccagttctaattaatgcacgtgtgaaaggacatarttattgtgaaaagaaatgctatcaaaacagtctaatggctacaagaagaaaaagaaaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccracttttctagaatgtgttgtctctgttcgacacctacaactctggttcattttctatgcattaaggatgatgtaactttaaaacctctcatgtaaattctgcctgttttctaattctacaatcctcttgtttatgttcyattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactrtattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaaktgaatggcttagccyagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttrattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaycttgaattagttattgcagtgcccaacagatatttagtattgctgtgtgtccttcaaatgtttacaatattccactgtgcctttgtgagttcactgcagcacsctgggrcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattatargcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcragctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgttttwctttgaccaataacatttctcagcttagtgtatgggctatgtaaagtgcctgtcaaatggagggatgtctttgtkgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggargacagttgacatttaccatatcatatgaccttgaagaagaggaagaagatacagaacrtgttctccagcttatgattatcttagaggtagagtactgagagcatgttcacccgtgttacttcctgatgttacttamggttaccagtactgtattttttacctgcctggtttgacactgacttacaggactactaaaaaaaaatataccttaggagwtttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttyctgtcttgaaactttcatgcatgtgaatctatgacaaaatgaaaaattcttttctcaaaatggacattttccagtattggatgaagtggtctgctctctctctttctgtctctctytytctctctctctststctctctytytctctctctctctctctctctctctctctctctctmtmtmtmtatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcrtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagygagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattktatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggaktttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcagkctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaargtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagcygagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtkcacartgcatataaatagtgcagaagaagtgtgcrcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcawatatatatatatatatatatatatatatatatatwgtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaakagtcagctaaagcatttgacttagttgacaattctttgatagctcatgcatctctaaaatttagtactatattattgccaacattatgtatttaaatgaatgcagcttgatatcaagaraatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaaygtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttaytgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggyatgtacatgcagtgaacaytagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgargggggaaaaaagcatttaatgattttcaaatgacacatgtaacctaaacactataggrcagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcragaatcagttgcttctttcttatggttacaagatgccatatcatatgctataaaatgtctatcggtaatttttaaaactgtgattattatgagtcaatagtagtcatttaattawgtgctcttagagtttatttaaaatttattttcatgcactaaaatgatttggagatacaaatagtgaaaagtatrtttcttgtaatgtttygtagtaatttttatttggtttcaacagtcaaygaaaataggttaataaaatgtctagtatttcataataacctactgtgtgttacatattayaccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtckccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatktgtatcacttaaaaacaaaacttgaatatctaccaaaagctgtggctttcaattagagtattamccacayaatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtckcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaayacattctagatatgtttgataaattctgtaaatttacctgtataaattattaataagtacatacaacataatccctgtcctatctgtttagggagacaataaatatctatgaaaaatgggatctcagcactrtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccayagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttktttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaaygattgatcagttggttgtggtgtcatttactgagctgaggaatagttggtgtgtgtkggggggtgggggcatggaatccatagtccagtttagaaattttcgatttgaaaacgctgtgaagtgtaaatrtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagaggscagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatrtaataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtastttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtrctttgggaaaaatattgggttacmtttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgayacaatacacaaagaggagaatatttgaatgttgctcatcaaggrcattcttactsttcagctgaccctgcattttagcttcttkttyatttttcatggttttaacccascattaagtagcatggtttttagcatgaaaaatawwtttataawtttataaagcttaacttgctttaaaatttgattataaattatctgaaaaatatttttggcaccaraacaaaatctaaacttctgcaatagtgtaggtstatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatctttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattcttyagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagmctgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacgcaatatcatgtattttcttaaggaaaataaagaaaaaatgaagtaagatttgyataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctaccyatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatacttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattmttttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgmgtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcrtctgtggaaaaattgtctccaacaaaasaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaaccckatggatttaccctcaagtctgaccaacattactataaatgcagaggaaacattagggagataattttgcttggataattataggcattcatgacccattgttgtctctttatttrttgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattaygttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatmtttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggtygtaactaggcagtaaaagttatctggagagaagcaaataacaatgtaactatttcgaatgtttatattctttaatttctggcatcacatagcttataggttaaataaaatatgaaagagacatgtgaatctcwgcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacawtcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttawtttgtttaaaaatttgtaaaaaaaaaaaaaaggcaaagtttttwaaaaaattaataagtcgtatctataatttattatggcaatatgctttcatactttttcagtataaaagggtttatcaaatcaatcatattattccattttgcagaatgggaaacaggtttagagaaatatatygttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccwtgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgtygagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagccyggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaataycttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccrtcaagcaagtctctattgaattgccctgtcatatataatagaaaacaaatctacttagggaaaacataataagagaaagattaattgagggcatttccctttaaaacrgtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgyttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcraaagtcagttaataacatgtcacagggatactgctctccactgggctatattcacgtctgcagaaatagcaatgtcatttcatcctccattggccagacmctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcrtattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaarccattctgtaagtgatttgtgtgatcagcttatgcacatcatctaaataagaccagaatttraaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagctwgaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctstaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaayaaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaagrcaggcaagttcatctggtggattctataggacaacatgaaacttaatgggatacatagacttcttaagcyctccccgctccccagctggcaaatttttaacaacttctccttaagtgatgagagaggggtcaaaagccaggactaatctcacaattgccactgaaaatgtggaaggtgtttgaayctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcaraattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatktgagcagggaaacaccctcagtcttttgctgattatgtcaaatgggaggaagtaagaacacagcattacagccacgmctctttatacagcagccaccctcttctgtgcctttgccaatacgttccctctgcctggaagattgcagccctttcactcctccayccgagwctaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatrtccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccrtacaccagtaatgtgctgaagtgttgcagaaaatagtcccactttcagtaacatggcatatgaattttctatcacgtatattcacaaattttccttacaygtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagamtcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagkactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttgrtaagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattytaaaacataacatttaggtcagagaaaatttgctgctatcgtttttaaaaatcttctttgccatgccctataaacaaacttttgtttttccaataatataatatattatataaatagttttatattatattatatttatataatatatataataatatataatatattatatttatataatatatataataatatataatatattatatttatataatatatataataatatataatatattatatttatataatatatataataatatataatatattatattatataataatatataatatattatataatatataatataaatagtttttggtaagaaagaaagagcaggagacaaagaaagaaagaaaacagagagggaaggaaggaaggaagggaggaaagagggaaggagggagagagggagggagggagggaggaaggaaggaaggaaaggaaggaaggaagggaggaaagagggagggagggarrgagggarggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcaygttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaagrctattttggacaaccctctgtacctggaggatcaygtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaaytgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatayttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcrttgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccargtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattrtgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcwtaattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaayttttctagattaatagtaacattaaaattttgccaggggtgctattaattttgaaaattcctcaaaaytattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgtkaattatccctacagcttgtagagttgttatagggattaaatgatagaatgcctaacagggyacttaacaaatcagaaaacattctgttactgaacttaggcgtccatgttaccatgtggggtatattattatttaacaagcctattaagactattagaaagttttcctgatcacaggtctctcttctctttgcarcctgtckctgtaatgccggtggctctttctctgaggtttgccacagtcaractggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacarcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctctkgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaaygcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccaggctgagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggygcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctccwaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactstctgccagggttgtcctgaggagtaaatgagtacatatttgtaaagagtttagatttgtaaagggtttagaattttagaattgtgctttgcaaaaaggaagcacaatatatgaatgctagttcttattaccccgagagagacacatttatgggaacctatmcagtttctcactgggtctggatagccactctctcccatatttattttacctcatyaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgmaactgcaattcttttgggtctaagtcattcgactgtgaagagagtggacaatrttggtgcyaacctggagtcacagggaagaaaygtgaccgctgtgcccacggctatttcaacttccaagaaggaggctgcacaggtctgtaaatatgacttaagtcctacatattcactctgatagttttagrgtctgacttctgtaacagtttgttcttttaaaggaagcacagattgatacaacgtatttaacataatgagtaatgtctacttatttttacrttacttaaaaaatgaaatacatgtcagtttgaaacactgccttaataactgtgtgcaagtactcagtaaaaatcagcagatgctcktttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatcyggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgyttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttattctaattgataagttattctaaatgataagtttataattgtagatcctctaagaatctgtatatctctaagccaatatctgtataacttaaaaattataaagctgtattttaaaatatactctgttctttaaatccaaarctcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagmaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagyggctataaaatatttagagtaatgcctagcatgtaagtgctatggaagcatttatcattattattattatctttattagttttattaattgtgttatacattgtgctttggcacaggaaaactagctarttactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagyaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccrctatgtggcatgcattccttgtcttggatggctttgaagatattctcaaacattatttttgcaatctttgaaaaagtacaaaaggtagataactttgtacyctttgaatattgcatgatagcaacaaaaatgaaaaatctatagaaaaaagtcaggtggtaaataaaaatmgaaagtatctttatatataaacagtgtccataattcaaccattttaaagtatttgcaaaattggattattctgttgtgtgcgtttctaactatatacatgatgtaccgaatttaagaagcttattaagcttattrgtttttactgcagatcgggctcatcaaggaaaaactaatccgtacagcataaacaaattagaaatgaacttaaaataaatatacaaacaaaatagtaaactttgtagtacccgaatataaggtgttacagttaacrtggaatctgataacaccaattctttcctttcttaaacttcataggaaagctaaaaatactttaacttttgaaattaataaatgaaatacatcttatatttattgaacagctcctttctgaaatacattgtactataatrtaaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggygatgcatttgccctcccaataccattggagagaaatgttctaaatgtgcacccaatacctggggccacagcattaccactggttgtaaggtgagtgaaccacttttttgctctgataattttttggrgagatttttgttttgtagagctctgtaaytgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaarattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctkaaaaatagaatcgtagtctgtytttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtmatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacrtatgttaaagcttgcttttcatatagattgctttttacctagtttcatcatctaatytttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccatygaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacakcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatastgattgattttcaacatatcaatccagtcttacaatcctcagattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacartcaatgaggtagaaaacagaaatactttagaggaacccaaaagctcactatttgaaaagatcagtaaagttggtaatattctagaaaggttaatyaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgrgayggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttaygattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttccttttttttttttttttttttgttccagaaaggtkttttttttttttccgaaratgtttttgcaragtatgtaatcctaaatactggtttgcagcaatttaattatgctttttgttttctttttgtgtgtttaataattattttttcatgggattagttaratctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatytgtattttttatttctgatagtttctattgttaagtgtccaaagtcactgattttttaatgcagcctaacctgtttttaatccaattgagtctattttttawtttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatrttttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcrggctttgggtttaccctctctgtgttgcagcctagaaattgcctctgtacactgcttcatgtttttttccttctctcagaaatcacagtcctgtgcttcctataattcaatatctaaaaacarttgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtrtcagacaattcttgcattgctataaagaaatacctgagactgattataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttrtgtcatggataatttctctgtgctaaggtgtgagcatacacatcatttgggctgttaytgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacatcctaattttgaaatttgattctacatctgatgttctttaagttacttggcggtgaggttagtgggttattctatgccttggaagctttgtccatatttataatatacaaataatcacattttagatctttgggtttaaaatatcttctagaagccgcccttattgcagcctttctactgattagcaataattagatagaaaaatacttacctataaagacaagaaataaagctaatcctgataatcatttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccrcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagcwagtcagaagggtgcctatggagagacaatgtgccctcccaactaaaggcacacctgggattctttctgggccactgggctcccgtgctaaataatacaaaaataatgatgaagattctttttttttttttagacrgagccttgctctgtcgcctaggctggagtgcagtggcgcratctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaamaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcaytttggacttctcctattatataatgcttattctatcatgttatgctaacatatttacttgtctccctctactasaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatgrttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggarctaccctcgctgcaatctctgtgactgcttcctccctgggacagatgccacaacctgtgattcagagactaaaaaatgctcctgtagtgatcaaactgggcagtgcacttgtaaggtatgtgctgctracatgcagctagggaaaacctccctcaattctgtttccattgctcagttttaacttcattcagtgtttgttatacctgcttcattaagctaaacaaacagatggacaaaatctcattgccagacatggagttttcattgrtatgcatttgttggcataccgataaacactrcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctrtgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcmgagatagcgccactgcactctggcctgggcgaaagagcgagactccgtctcaaaaaaaaaaaaaaaaaaaaaaaaagtmcaatacctttagtcttatatctatttaaaaakaargcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcagrtgaatgtggaaggcatccactgtgacagatgccggcctggcaaattcggactcgatgccaagaatccacttggctgcagcagctgctattgcttcggcactactacccagtgctctgaarcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattaygttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattytacccctggtagatgaggctctgcagcacrcgaccaccaagggcattgtttttcaacatccagagattgttgcccacatggacctgatgagagaagatctccatttggaacctttttattggaaacttccagaayaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagatacyaatcaatggttttgcattcagttttgtcatagtgatttctcttcttgttaacagaaagaatggaaatattatggggatgatcctcgagtccatagaactgtgaccygagaagacttcttggatatactatatgatattcattrcattcttatcaaagctacttatggaaatttcatgcgacaaagcaggtaaactctaatagaaaatattcaagctcttattttagagtctgtaaggaaggttattgacctacagatatcagrtaagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctrtgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaaytgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaaycttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaawatacttaaaaaacrctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtwtgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgsgatagtagtaaattmaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatyacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaartaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagacwctgtctcaaataaataaataaataaataaataaataaaaagaaaaaaraaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgrgtttgaatctcgacttcaccatacagtaagcctgagaccctgcactgggtgctacacctctttaggctttagcaggtaaacaccaagtccytgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaargaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgartgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccaytgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttawacatagcaaaggtacattaaaaatatagttttataatcttatgggaccactgtcgtacacatggtcctatcattgaccaaaatgtcattatgcagcarcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaayagtggggaagagaactttggaaaagtttaaattagagtagaaatgggtaagaggagctcaggaaagtatttatttgcttttctttaattccccattgtgttccagawaggattttagatgggactcaaaaagtaacttttttgcttccaattccaacataatcattctcacraacttttgtctcagttcaccaagaggaaaaacattcaatattgacaaacaccctaaaaattatttaaattgaaagaatagtgcaaaataatcaaggaaaagagagaatttctgttttttttttwaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggacyggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatrtattatatatattttatatattatatatataatttatatatataatatataatttatatattatatrtatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaraaaaaattctacttaaccaaggtggtaaaatagtccccttgtaattctccatgggatttgaaaaactgactyctaccttttattcataaatcaagcaatgtctgcagctatgcatgaggagaggactgagcctgaaacacaagacggttytcatcttcgtgccagagctgtggactaccttccagaaagccagagatgtttgttgatacattttcataataaacccaaatgaagatggaagtcttgattttgcatatgtcakyttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagcyactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctsttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataycccgcagaatcctcctcttccctcagtgttctcttcatcatgctctgactgaaacccaactctcactttgcatgctgctaccccggcagccctcttaaggagtagccatcacctttttgtttttttttycccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacrgggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggsaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctgktctccatttgaagcgtttttttgttgttgtttgktttttktttktttttttttttttttcccactgtgtcktttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaamaagctcccactactgcatgcacccacttttctgcatctgtgcccaattattatgactcttttctattactttggatgaattattcttgtttccagaaaagrtcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcaygtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagaygctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatwtaaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttawgtttaccattttttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccrtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagygtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattaygaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcaytaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgygcacaagattgaaaatatgagccagatgttagccagctgataggttgatgggcatatacgttgctaaaaaaatgtgacccagagtacactctagtgatatctccaatgatgaggcrtaagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcytgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaatawgttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggkcatggtttgatatgttcataggatgatcactctgattgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttaytcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattygagtagcygcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacraaaattaactgggyatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggartgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttaytcaggaggcagaggttgcagtgagccaagatggtgccactgcactccagcctgggcgacagagctctgtctcaaaaaaaaaaaaaaaaaaaaagagaaaaagaaaagaaaagaaaagamaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgaytaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaarggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgayagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaawgtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatggrtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatcyaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccrcctgaagcacatagaagccaataacgttggcactggcttcggagaaaagaaaggctttactgcaaaattgttcagcaaggagacaagagtcaggttcaaatctgtctccctaatttgggatatggggaaggttgcaagggrtcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccagrttttgattttgtccctgtcttgttggttcaaggggaggaatagttggttcctggtgttgttagagktcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatytcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgayggagtggcagtgctcacacacccttagaagtttccagtgccttcccaaggaaagatcagactctttgagcattasaaaccctctgtaatctgactacctttccaggctccaagccctcaactccattctatayaawgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccrgaagaccttttatgtgatataaggaaacagtgcaatccaccataatatcataatttgaaaaaaattrtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattagktcctaatkgcacctgaccaaaaggagctgtgggcctggcctatacaccttattgcctgttttcagcatcaactgatttagtgaagcagcaaaaagaaaaatggtgtgtgcagyattatctttctgccacagatacatgtttttaatttccaagtttccaatrcatcattcagttttatctaaygggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatytggatgtaaattagaaaagayattattttattccaagtgaaacatgtattcacacttcacgtcttgaagcaccagtggccatttgggctgagttttcaagaaaaaaaawttatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgaygactaccgctgcacggcttgtccacggggatatgaaggccagtactgtgaaaggtaccaacagccatgaaaygtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatrtaacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttmcccgcccttcctgcagtggcccatgactaaccagcgtgagagtacaaaagtccagctctttggcccctaagtgraacaagttttgagatcttattttatgctccagagcactccatggaatcaggctaagactgggacatcacytgaaatyataccyttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacmcggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcaytggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgmacgtgcygacctggagccacgggaaggaagtgtgacggctgcmagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaakctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaaygtatttacaggggttatacatggtatttagttcagttgctggactggaagtgtttatattctttttaaaagaakagcagtttttattccagaaaaaaatattaaattataggattgtttttgatatctagactcttttkctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaackagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtawgttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcmtaaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgtygtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttyttatttgaaaggacagtaagtatgtcatagttttctrtagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgaggaagctgttctgctagctgattaaggagttgcacagttgaattatcgtatagagacagctgatcactgttgcctttgttttcagcaagttttatttgaagagtaaactaaactctactttgattgcaatttctactctggcaaggctcaggaggttttattgaccttgaaagacaaactaaaatcacataatcttaaagttggaagaaataagtaaactagcctagccttctctttttctgtgacatccacaaaacagacagcatcctaatgcaaggaagcatggtgttatgaagtggctacagaaggtttgaaacctagcttgcaatttgtgtgacattatttaatttcctaaacctcattttcatcctctgtaaaatggatgtaaaatgctacatacatgtatgtgaagtatctaagcataataggtgctcaataaattctaggcattgttatcatcattgttattatgtgaccatttttttccccaaagacctgatgttttgtgcaacscatcagtttctgatgaaatattttctttagtttargctgactttcagtttcctgttactatctctaattctaggttcttcaagtcactgaaaaccacttttatggccaccttacatttctcctgtctttaagcccttcacatgcattatttatagattcataaacactctggttgtgactatttttctcatctgtaaaatgaggatatgaatggtacttacctcatagaattgctttaaatattaagtgagataatgatggcaaagtataatacattgccagtcatgtagtgactgttgtgtagataaaaactattatcccattattatttatagtactttcaaagtttccattagtgttttgaagagttacaccatctttgaaccacattgaacttgttttcccatgtattatatatagaattttatttaatatatataaaacacatatatcaatatttaatatataaaaaatatataaaatatatacatataaaacacatatcataaaacatatatataaaacataaatatcgttacttggtatgtcgacaaattcatcagtctcagctgargtctacagctttcctctctattcaaagaaatgacaggttaaaaggtcttcttaatgactctggaatcaaatttttatttgagaagatatttattttaaaatagaatgaytaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatrtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggwtttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagasagatgttagtatattgcttggagcgtactataaaacttacctttcacttatggaaatgtgcttgtactttgttccccaaaaagcaaatacagataccataagacatgggataataataaacctttggacacaraaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgyccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaaccttttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctyttccaaatccttgctcccttgaagattgagcatccctataatttrtcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcrcattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaasatgtatatagcattgatacctctatctgcagaatgtaagaaattgtaactgtwtacatgagagtatattataaatgcagtagttcctgctccttggcrtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggytggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcrgtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagacttttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttaggggrtacttttaatgttatattctatgccttaaaggaaatcttcaatacttgtgcaatacactttttctccccaaatctatttgctcstcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattartccttacaaaaccaataaaattcaaattaaaaacattaatataaagtaacatgattttggctgaatggaaattgctgcttgcaacaagaataggatattgastattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtrgccatattcatctctcargtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatgraaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcratgtctagtgaaggcctgttcctcacagagggtgacttcttgctatgaccccacrtttaattcatttaatatctggatactgaggaaaaggatagctagctctctggggtctctttaataagggcactaatcccaatcatgaaggctacattctcatgactcaatcacttcccaaaggctccacctcctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgkgccagrcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcraacactatcactgcaaggccatttactaaaaatgtttatgggatggaatctttttcagcacttgctgtcacctcagcgggccccagagaggcttattcagctggcagagggcaatctgaatacactcgtgacmgaaatgaacgagctgctgacsagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctycgtggtaaagtttgtatctgttctgatttccaaaagcactatctttgattgtgtaaagagaaagaaaaacaaatgaaaatrcttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatayagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcrcagtccttgccctcattggcttagtatagtctaatgatctgacgttagagacacaaraagtatttcttttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattcyatgggtttggaaaaatgcattatgacatgtgtccaccgttgttgtaaaatatagaaaagttttactgcccgaaaactcctctatgcttcacctattcatacctccctcytccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcataygcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgarcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacracactgtcaaaaatactgtaacagtgtttctgatgactttgagagtttggacaggttcrtgtgtttggtaagctgtccctcarttggggtttgcctcatatctttctcatgattagaatggaattatgagtttttgtgggaaaaacttcagaggtaaagtaccatkttcatcacatcaagaacccatgtgaccaatatgacttattactgtggatattgaccctgatcacctgactaacatagtgtttgccagatttttccactgtaaagttactcttttatgcccttttcatactctaatactatttttatctrcccattcttcagrttcagtaacataaaaggcgcagaaataggactactgaaagcaaagatcactttgatgggttgagaagggggaggaaatgtaaatactcattaattacttttttcctaccatatttataattasaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaawtaccaggagccctatctcacacccataggttgtgatgcagttggtctggggtagagtcagaccactgggatattcaagaactccccagattatacwgataaagaattactgtgatcctgtagttacctaatagctaagactctcttccctctggaaaatgccttaattggtactgccaatcttttttttttttttttaaacagagtttcacccttgttgtcsaggctggagtacaatggtgtgaactcagctcactgcaacctccacctcctaggttcaagcaattctcctgcttcagcctcccaagtagctgggattgcaggcacctgctaccatgcccagctaattttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatstcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacayatttctttattttgccttaaaggtaatctacctctccctacattttgttaatttctgttaactccaatttacctttcaaatctcagctcrtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattrtacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttkctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacrtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcrtaacattatcaatagcctgtcctgggtgagattgatttttgtgaattttgctttggcagtgataccactatctatcaccactacccataggtgatagtgcatttgtcataggcttctttatgaagtctctygtgggwatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggrtgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccrggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcwcatgcctggctctyctcccaagcttcaactgtagctcttgagcagcagcttcctctgagcttctaaaaaatgcccagaaaaytgcccagccaaccacatttcctggcaagcatagcaccaggcatatggtcagtttgagtgctattagataggctttagaacttccaagggatcattggtttgattgtcattgtatccaccaatcacccaacatctwtgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttwcagttggagaggttgtcaataaataggtgagccaattactaagtaaktctcaaatccatggtgctatgaaggaaacgtcctgctgcaggaagtgtggaaacctaggtagcaccctgggaatggccacrctaaggagaagcacttaaactgaaagctgatgggtaacaaggacccagtctttamaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcrgtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggaytggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaaattttaattttccaatggattcttatcctttcatcctttcatttgtgatgttaacacttgcaggwtgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaagrcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccraatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacrttttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagygacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcawgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagyggatccccaaaggccctagtcaatgctccaggaactttccttttctttccattgacatttcaaacacccaacaccyagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccamgtctatacaccagagaaaggattacccatcaccaaaggtgtctctcrttccctaaattatgcatagatcargtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagggaggggagggaggggagggagggaggaaggaacagagggaggaaaggggaagggagagaggaaagaaggaagggaaaggagggaggaaggaagaaaggaaatggaaagaaggaaggaaagaggaagggggggaaagaaggaagggaaaggagggagggaggaagaaaagaagaaaagggaaggaaggaaggaaggaaggaaggggaaataagaaagggagggacggaaggaaggactcaccaaaggctttaaagtaggttatactgtatatccacacctctttttctctctctctaaactataataatgagggataaccatcagtacttttacatttttgtttgtcagttgtaataaattgctgtgggaaaagtaaatgcttcagactgacatttatctatttcagctttatgtttggatagatgtactattcatcctatctttcattatgagtcatgacctcgttatagataatcaccttctattcatctaagrcattcttatctcactataattttataatatctaccgtgctatgactcctgattagttcataaataaactgttttattccacgcattattagaattaatgagtggacataggtaaacccattagtgtttatttcctgacatacaataggacttaatcaatgatagacacctttccttcctgtttctcagatcagagtattactttctattcttaataaatttacccatcagaggattttgttttcagtcttagtatgaaaacagttttgcttctcctgaggaatttttacttacctttatagatactgtatgcctcttaagaatcctatttgtattccctgctacrcgtagtctactaagatgcttagtagtggacttaggatgcactgcattgaacgttatggcatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcrcacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatckcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaagggrggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgartatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggyttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttcyycaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaatwatcacttttcctaagagtaaactcagcacatataacagcagcaccctgtatktgatattaatatttaaacaacaacaactttctccccagagacaaatttacctttgctgttttcaaagtatctgactccaacaggtcagaaaacagcagcagacctatacrtcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcrccctgctcggtgacacaccagccgtgtgacttacccgaaggtgcacytgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacrtggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggyatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggrccccatccctaaatgaccaactsaraaactctgagaatggggcccagaaatccgtgttttaaaaattcctccagtgattaaratgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcactkaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtyaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagacmstgtctcaaaaaaaaaaaaaagaaaaagaaaataaaagaaaacaataatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttargtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactytgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtytcagaaaaaaaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaasattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacagagtttcgctcttgtcacccaggctggattgcaatggtgcaatcttggctcactttaacctccacctctcaggtcaagtgatkctcctgcctcagcctcccaagtagctgagattacaggcatgcaccaccacacccagctaattttgtatttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgaytgagacaaggataggtgctattttagataggtaatcagaggagtggctattaccagaatggagggaggamacaagccaaagagtaggaagagcacatagtgggaakatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacrcagacattcaggccactgccctttacttatycaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctrttctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatarattctagaattcaayatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaragcggcaaacgacaaattgagaacactttaaaagarggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctrttggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctatwccattaaataatgactttaattctctattctttttgctatgttagtaagtttgaagtttcattttaaaactaaacatgtgggccaggcacggtggctcaygcctgtaatcccagcactttgggaggccgaggtgggcagaytgcctgagctcgggagttcaaaaccagcctgggcaacatggygaaaccccgtctctattaaatattcaaaaaattagctgggtgtggtggtgggcacctgtaatcccagctactcaggaggctgaggcaggagaattgcttgaaccagggaggcagaggttgcagtgagctgagatygcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagcttygctacagcagcatcaaaagtctgatttacaagtagactcaaatatggcttagtaggaagtgaacatagccctaggctacacttagaaaaarttattttctgttctttattaaaaagcacagtggttgccttattagcattttaaataacatatatgaaaayacattctgtttcaaatttcagtttcatgtttctaatggaatcaaaacaatttattgttaaaaggatggcttttgaaaatttggycccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttrgtctcttcygggaagtgcacctaccccagaaagattttgtgaaattaattccagtaatgtagtacaagtgctctgaatctcacagcatgcttcacaaataargtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcrtataattaggacgttcttcatttgagtaccattgagtgccctgacatwcyktttttgaatcatcccaccagaatccttgatgaggctaaaaacatctccttcaatgccactgcagccttcaaagcttacagcaatattaaggactatattgatgaagctgagaaagttgccaaagaarccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggytatttttgaagacctcttttaaaatttgcctaaaataaattctcggtatgctataattatagcagaactcttttctcagtcacccactaccactgttagggtsttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgyatataatcacacacaarttggttacatatgaagtttggctataaaatkcactttttaataaaaacatactggatcatatgcttctaaacaatttataccatgtttatgaattaatgaatttttatgaatttttgaattaaaaagctcttaacctttggctacaatcattgttcrtaatacatttggaacaagtattttagagtttgggcattccaarttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttkggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggyttctcttgagtgagccctactaatgccrtatgttctgtyracttcttattcaaaatagtggcatgatcattgcagaagcatttctatgttcagttatcctttcagaatgaatctacttttcaaatctaaactaaattttaatccatcttctgwtagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaartgtctgaaaaattacaaaataagtgctatagagaatcagtgatttattaaatgactatyggataagaaaaagaagacaatctgtcccagaaattttgttggaatgtttttcatgaacagaatgaataaaattttagtttaatagatcagtataatrtagttctactttgctggaaaagaaatatatttgaaaagcattacgttgagtaattatctagataggactaacatcccataaatatragatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaawttatacatttgcaggagraaaggaaaaggtcaagtagtasagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaayacsatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgktcaagggcaggaagtatccagcatgggtgaaagatgaaggctggaagagtcagaagatctrctctttccactttcttctgcctgcttttattctagccacactggcagcttattagatggtgcccacccacattgagggtgggtctgcctcttccagtccagtgactcmaattttaatctcctttggcaacaccctcacagagacacccaggaacaatactttgcatcsttcaatccaatcaagctgatactcaatattagtcatcacaagtccamcccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaatraattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgmaacccccttcttagcctgttgacttggaggtaggagggccccaattggccaggtggtaatcttaacttccagtttaatggaatcattgttgtatcccttggtgacagcattcttccctctggaactaagatgtctaggccagcagaacataatgttgtgggaacaggaagcaaaattttgctagtgggtcactagyggtgatggtgagtggtgccacttccgcttccaccccttgattctgggacmcgtgaacactggctatgggagaaacagtaccatattttggacactgattcaaggcatacacagccttctggagaactttgccccagtccggcaaagtwttgtcacctagttggcattgtaattatgacttcaaaagggcattccacaattctatcaatccacctgcttcrggatgatgggaaacatgataagaccagtgaattccatgagcatgagcccagtgctgcacttctttagctgtaaagtgagtgccttgttcagaggcaatgctgtgtggaataccatgacagcgartaaggcattctgggagttcacggatggtactcttggcagaaacattgggcgtaggatgggcaaatccatatccagaataagtgcctattccaktgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtycatccacatacctcttccccagattactttgccaccaattttttaatcatgcttcttccaagtccctgaccatccagccaaaccattggctacagcacattaattagtatataattacacatctggccatttcttcttccaagcaagtgcacarccaggtrccctgctcaaaattctgccccctrggaagacttccctttgctactgtccttcagggatgtcctagaaaggggctgtagtgctgcagctgtccacttttgggtgctacctgcatatcttgcagaatcatctgtgaaccaggccctagtcttctctkcctctgtcaactgatcatggggaactccctgtgaggccatcagtgcaggcttggggagagaaggcagggtggcaggagtggaggccatgggcrtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcartttaggttgcatggtgacttgatgacytacagtcaaacrttcagtttctaccaaagcccagtaacaggccaagagttgtctctcaaatggagagtrgtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatayggcccaatyggcagagcagtttgcacagcagtctggactygttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagyacactctcagtgacacgaggatatgaggccctcctctgcccatttmcactggaaatgtcttagatgtcttagtgcttttcaatcaggtatatccaaacaacaaacaaacaaataaartaagactaatgcagaatgaatwmcatagttcagrttcttcaasataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaakgacatttttamttcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggagsctgcaaagtcccagtatctgtgagctgcagatccatgatatagttcactttgagtccaaaggccagagaatcacgggagctgatggtacaaaccacagttcaagaactagagagaaaatgagatgagatgtcccagctcaayctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatsacactggccttcaactccagtgcacaatgtggtcttcctctttattctccaaattcaagttctcttacttgctacagttgtccatatttcttgggaaccatcattctaaaaaatgytgaccaggcctttcttaggcatttctaggaaaaataatataaaatacagaataaagtgaggggagttcagatataatgcatttctcatagaaaaaatgwtagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcraatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagraaatgtgtacaaatctaagtaagcattatggaaagcataatgataataattattaaatatgtggaattaaaaacaaagtggaactaaaacacaagagactaataamatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattygagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatayrgtgtagcctccaaggcagggaagagaaaaaatgaagagacatgtaggcccctaccrtactggctcatgaagcctggaccacgtctggtctgagtcattgaccagaagtagccgtgtgccccargctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctakgtatgacttacacaaatacygcaaatcttaggggaacagaaagactgaaaatgagagataagatacactatgcaaactctaaccagaagaaagctggtatgctaccattaatagcaatcaaaaagacttyaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagaycataaagcaagtatcagcaaatcctaatgatccaatagcatctagactacatcctcktatcataatgcaatacaattagaaattggtacaaaacaattgacaaaaagttttaaaataaaaaacatacttcaaagtaatccatggcttgagaaaaaaacacagtttaaatttacraagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgmgcaattttattcaaacacatttgaatacttaggtgaagtaaacartaagtttagagcaaaatttactcaaaaagaaatagtacacctgagaactataaccgttaaataaattgcatcagtagttaatasaacaaaataacaatatgtacaaaaatgtaaaggacccattatgcaatttgttcccaakaatggaaaaagaagaaaaatttcctcagcttattttatgaggctgatacaatcttgatggcaagccctacagaggacagtactacaaagaaaaactataggccagttatttaaatagagaagctayaaatgaaatattataaaacccagttcaaatgtacatattttaaagatctgtaaatatacagtaaaacattaacatttgccagatayrgatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatrggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgaaggagatgtagttcacttacagaatatcacatcacattttcccacccttcagtttcccaatataggtacattactgtgcttagattcttcatttttaacctaatatactgagagcattatttcctgtataaatgatagactctgcactctttaagatgaagctatttatgtcctcattcttccctttagcttccttttttcctcgtcctctcagcttctacctctttaactttgatattgtgatggtcaataacatttacattttatctataaccataattgtgccatggcagaatacagaagtcccttctctgaagacattttattccttaaaggactccctttgattttttttcagtgggccatttgatgcttrattgccagttgctctgtgcagaagagaaggggtattttattccataaaataacttgcagtgaattattcctttttattttcacaactgactctcattctctaccttacctgttctttctgaggcctggccttctccaaattttttctatctccttgctggcatataccctatagtgcaagttgtgggtacaataactgcaaaagattgaggagcaggaactatctaaataaccatggtggctgggtgcagtgactcatgccggtaatcccagcactttgggaggctgaggtgggaagattgcttgagcccaggagtttgagaccagcctggacaacatggcgaaamcccatctctactaaaaatacaaaaattagccaggcatggtgacacatgcctgtaatccaggctactcaggaggctgaggtgggaggatcccctgagcctgggaagtcaaggctgcagtgagccaagatcatgccactgcactccagcctgcgtgacagagcaagaccttatctcacaaaaaagaaaataaaaggcccatggtggtgtggctaggaaagagtgccaaccctgtccaaagggaagctttctttgctgaaattatacactttctttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcccaaagtgctgggattacaggcgtgagccaccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcarccctgtttgtgttgtagctctctcatttccaccatttgcgggggggtcccaagttcttgtcccacatcctggaagaatgaggtttgcagacaactggagggttagcaaggtgaagaggtgctttaytgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccgrggttttttatgggcytcagaggggaggaagtgtatgctgattggtccatgggtggccatgagctggcccaaaaaaagcaccrtaagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactgrcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatakgcacacctggctgggttgcaacagcctcagctttgctctgaaatcagcytgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagckgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctstaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatkaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcacttyacataaacacattgcagccagtcaccaacccttacatatatccctgcacagtttgagcagttttctttattgaaaatatttttaatttaaaatcatttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttaraaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattayatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatrtggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacrttcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcartccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctrtagcacgtcataatgctgctcagttatgtccttacaacaccgccagttatcatgcatygagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaraggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcrctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactrtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagscattttttttccaagagaaaaagaaatctaaagacaagcattgtaggaagggttaggagacagaaatgttcrttagtttaaatttmttttttttgtagttcaggtagtacattatttaaagtaatgaaaacccacaractactcragtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttytaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcwtggtggtgggtgcctgtaatcccagctactcrggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacartaagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcasatcagaagagggtttctccataacctgactccctgtgaaacagtcatctctgaggttsccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggattttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcytgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcrtcccgatatttagttgaaaagtgaggaatatatacataggtatacatatgtttaggaaatataaaaasgaaataaacttaggttctggaccaagtaatttaaataaaaaakgaataaagtcataaatagcattattataataaaaactggtaaaacacaccaggacaattttcaaaccaatgtcagtgtgttaccttttacttactgcctatggtaaatccagsactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattmcctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaargtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagmtatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtccmgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtcyctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctrtcagtagaattgccaaaccaaatacatgtctatttaaaattctaataaacttattaacttgctcttcaaacaatggaatcaatctgcacgtccactagcactcttgtgaacacttggcattatcatacatttaatwttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattcyactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattrtaaaactcatccttcagtattggcaggggattggttccaggacccccccccacagatatcaaaattcttgaatactcaagtcccttttataaaatggcatagtatttgcatataacctatgcatagcctcccayatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttytatattgttaaagcatgatataataacaacaaagattataaacacttattgagtacttaatatacttatgttaagtgtatgtaatcctcataccaattggagcaaaaacatttgcttcatttgctygcatcaattggtcatatatatatatatatatatatatmtmtawctcaattggttatatagataacataagtatagataacataggtaacattcagaatagtcacttcactactttaagagctaattaggtattcatacagatacagaacctactgacacagaaggacaacttgtcttctgtgtataacataagttagcactaacacttaacatcagttaagatactgttattatccccactttacaggtgagaaacagacagaggatactgaaggccattgttaaaagtggcacagaggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacraatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctrgaatccaagtcttctagctctgccccggtgcttttttcctctgaaatttttccagttgagaagagattasgaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatytgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcrtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaacwgaatttctctatagaattaactagattatgctgtttctgataacacaaattcaccccaacacacgaatgacttaattgcaagaggattaaaatagatwaggtctacaytgttgttgtttttacccactgaagctcactttttcctctccttgtaattattctcaacttctgtagaattatatttggagaaacacataataaaactaggtcttaacaaatgarcaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatawtagacctgataaatcaaaaaggtgactccttaggaatatagattaaaaattaagtgattgtcaagwttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagyatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagaygtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacrttaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatgggkttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggrgggaggcgaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttsagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctygtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagakaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttccyctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctcyggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatrcttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacasaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcamccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccrgctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgcyagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcrgtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcytggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattmactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattartwgtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaagrtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaagkcaaatgaaaggaagaaaactacagtgtttagtcacatttactttcatttgtcagtataccatcatttctgttaaattatactttcagatccagtgatttaagaatgctaatgagaataaagctattttatttacttyttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaattwgaattggtaaaattaacaaacatgcctgagcatwatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgayagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtckacatagccaccatagaaaaatgcagtttcaaaacactgaaattcttatgtaacataccaggtccaccctacttaaaatgggaagtaactgagaactgattcagttattctatctttggagctttaatgcaattatcaacrtctagtaccatatakattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaacyggktttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctcygcattttatatcttttaaatctggaattaccagaaatgtgatgcatatttcatttyctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttytcaagttgctcttattcttataggatgatgcacttaatattcataattgcttcatgacagtccttgcgcatttcaaattgcagaatgcctgccttttaaagaagcttgtgttsattaaatggaattaggtgttgggaaaccactatgggtgagatgcaggagcacaaccaaatataatggataatcctgggcttgtcagaatcatcctgagwtgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttastgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaartcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcrtgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacatyacagacaaaagaatagaattgtggagaaggtcagcagctcacctaaagttagaagctaggaagtgtttatttactgatgatgaaaactgrtatagcaaaaagtaatcagcattcgtggattaaatagttgagcttttcccctgttgttgactcatcctgtagtagctctaaggatacggacagamtatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtgraatttccgagaaaaagaaggtgactgcaaaggatgcactgtcaggttagttgagatgagaactctcccagggtctgtcctgtgcataataaaagcttcgwttttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacmtatgggatytaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgyttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttatacyccytgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacasttgtgtaagtttttagcaggtcagccccaaccctattttcccataagccctgttatttgtaagaataatttttatagaactcctggtgtttgtttgtttgtttgtttgtttatttgttgytttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtktttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgayttagttattgcacacctcatgaaaggtgagaggtggtttttacttattctagcacggtggcartagagatggagataagtggaaggaatgaagatgtatttagggtatttcctgccctacaacagcctatagtctcattgctattcagtgatgcattgaataatgacagacygaatagatatgatctgattcatgtgaaatgtctctcttctcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacaygagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcrtacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacrtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtraaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagygaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccmtttcttaaaagactaaatatacatctaccatacaaaccaatcatttcactcctaattattcacccaggacacaagaaagcatattttttatasaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttsatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgrattcagataaagtttaaaagaactccactgagtttgggtataggcaggtccctgaggactttagcaagaccagagatgacagagtagtgggagaggaattgaaataagrctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactycctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtycttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagrataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggyggtagtgagagggatcaatgagataaggagttcctgtctgctttctaaacaatgcagtttgaacagagaagtgcctcatctttccttttttccatctatttctgaattcttatcttcatmacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatrtttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagwaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtytgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgytaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagcygtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacattyacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaargctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacacygccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattamcaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaackactgatttggacagtgcagaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtagrtactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgtkattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactmtgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttrgactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttstctttggtgaaaaaaataaaacttatttcattacacatrtaaagcatcaataagaagtcagttaattcctgtacctcatgtttaaatgctgtgggtgagattattgytaaaggggagaaggactacaaaaagactccttctgcaggataacatgaacatccatttagaccaaccagtagayaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcrcttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaatttyccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattsaagtttacacaagtagcaagtagtaatttacaccrtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttygtttaactattttgcactgtttcttcagttgacactgacccatatgtgagaaagaccccggccatagctctactctcttaaaatatccataagcaagagtcaatagtcaacagcaaatattarcaagaattttatagaaactcaatagtgatcagcttgtttttaaaatgaaaaygttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccayttgaatgatgaggtttaaagactggaacagaactttcaggatcttcattgttcatagctacaggctccaatttggaattggccatagacacccactctgagaagtttgggaataagaaaagagaaaayacattaagaactaaaactgtaaggacccatactgkcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtrgaaagtcctcctgccattaaaagtgactatctacatttactgagagagtgatatcttccacatatgtaagaaaaaaaagtcattaggaatgaacatgtctatcaagattcattttaaatayagggaggaggagagaggaagatggcaaggttgtgaaagagtgaatgaatgaatgaatgaawgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgktttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacytgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatstatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatwtttccatgctggcctcctatttcactcrcatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtraattcctctaagatcattttcccagttgcacaagctgaagwaatagtcttttgggcctgactcatcccatcctctctggacacaaagaagggcagaaaatggatctgggagaaagcaagtagaacacaaccaacacagacagggacaattwtatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaamtgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatccyctgtccatttgrttctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaakgtgggtagatcacaaggtcaggatttcgagaccagcctggccaacatagtgaaatcctgtctaatttgtatactaaaaatacaaaaaattagccaggcatggtagcaggtgcctrtaatcccagytacttgggaggctgaggcaggagaattgcttgaacctgggaggcygaggttgcagtgagccgagattgtgccattgcactccagcctgcgcgacaatgtgagactccgacycsaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggarctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattatragtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgytatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagwgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaacsgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgyaatactcctcaacaggggccgtctggaagtgcatctctccacaggggcacgaacaatgaggaaaattgtsatcagaccagagccraatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacmtactatgcattgcaaaaggataccgtagyttaattccctcttctttacttttcatacttcgggaacctcatttgcytcagcccttaggagttctacccttaacatttttattcgtgcagttatctmcacctttggaaaaaccaaatgcattttctgaagctataaataagaaaaatccctccctctgcccctcttaaatattacctcctcaaataaggtatgcacacagyraaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttaraaggacaattagagaaaaaagaaacagaagcccagagacttcaggggttcagacctccaagccagcaatccatttatcagactgaagacatagaaaagaactggaaatccaatttgatgaggcctcaaaayacagaggatacttttaaatgcaacgagtatgaatatgtagcagtagttcagccaagccaatactatcctgcagtgaaagacctacatttactaattatcctcttgkggaaaacatttagataagyaataaagatttcttaccttctaagtaaacaacaaagctttcctcagtttttattattattattattaggtagaggattaggctgtaggatgaattgatacaaagcrttcatgcagaatggctactgagacgtttagaaaccatgatcgagacaaatgagggatcatttatttggacaaactgagaacttttactaatctaayagccagatattgtagtcatggtctctgaggagaaatgcaaactgaatgctctcatttgaatcttagaatgctttagaatcctggtttcacatgtcttctagattagatgktaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaayattagccagacatggtggtaggcgcctgtaatcacagctactctggaggctgaggcaggagaaatgcttaaaccagggggacagaggtttcagtgagcygagatcgcaccactgcactcyagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactrttgtaccactatgccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacraacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttcatcacagatgagaaaatattaactaacytgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttyaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgcyttggtggccagcagttcttactggacaaaaacatcaaaccctaagagcctgaagtagttacttaagcaaataggacaagcaactgaactgaktttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggtttwaaaaaaaatcttaaacccacattccaaacaaataagaaatagggtataagtaatcargtaattatgaaactctaagaatcagccaytgaaactgtaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaakgtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttrcagttcaagtggatgaaaacagaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaayttagactgagaaaagcacactaatggacttaaaaaggcatgcggggattgggcttaattgtaaggaagcaaaaaaackaaaataaaaaaatcttatttattacattctattagccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccrggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctcyggaacactctgcctttccaatttattctacttttaatagaccatggtaggctattgagagtgtttccagtttttcactattagaaactatactctgatgagctcctctatgcatcaagcttttycattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagmagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacakaagcaaaaagttgagtagcatgccaaattggttggtttagaaagaatcacagaacattagagctagaagacaccctaaagaktccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgytacccaggctggastgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccayttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatmtattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagrccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttawttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaamtgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatrtgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgayatgagaaaactgattcacacgcactgagcactcrataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccmtcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacacsccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttsctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccayggaacactgagtggggaacctggagccaaactgtcttggtttgaatacctatttaactattgactagctgtgtgttttggagcaagttaatctyttttaacaaagatttctcttttgcaaaacagggtaatgataatactaaacaaaaaggattgcataaagattaaatgaggtaatttatttaaagtgattgggttgggcrtggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccakagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaattttwttgtgggtacacagtgggtgtatatatttatgggtgacctgagatattttgatgtargcatgcaatgcataataatcatatcagggtaaatggggtatccatcacctcaaacatgtatcctttatgtttcaaacaatctgattatactcttttagttatttttaaatgtacaattattttttttttttwactgtagttacccttgtgctagcraatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaaygtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaatagkattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatrtattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaargcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaaatcaaagagtcaaatatggaaaatcatagaggaaagaattaattaactggatgaacaagataagtctatttatgtcccagaagcttcccatcaacattgtacttacagtttctctctttattaataaaatgtgtggcaacttttgaamcctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcaktaagacaactttgcactayaggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttaygcaaactccacccaatatagtaaacatttcattaataattacatcaatagagtttacaaacttttcacctatttacttgcatttttaatctttcttcttaagacttcatttcttttcttttaccttgtcgaatgtcttgccaaacygactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttwaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagtttwaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcrggcagattcactgctgtctatgatgctggggttccagggcatttgtgtgatggacaatggcataaagtcrctgccaacaagatcaaacaccgcattgagctcacagtygatgggaaccaggtggaagcccaaagcccaaacccagcatctacatcagctgacacaaatgaccctgtgtttgttggaggcttcccaggtgagtgttggctaccccagcaacmatttctttgctctcttatrttactggttttgaaaacatttatatttacrtgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatchtaaaatgttatggaacttatttcctcaagttctggaaatcattgggttaaacatagctaatttccccsttatgttattatagagtttatatttatattacaaagaaacgcaagcaataaatcctcattcagaatccttctctagcacrttaaatatagcatgtgaactgtagagatttacctaaagtgcccataaacaagagtggccaacttgatgagaagtaagccaagtgccycttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtwatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacmaacaaatatattttacctatatatgttaattaaactaatttgtgcatgtacatagaattcyttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctccagtcatctcaaggaaagagttcagatgtaatttatggaggcaattttttttaacttattcctatcaatacttcttctttcttttatcatcctttaccatgtatgacagctttggccttctgtccaagccactgacagcaagtgaatttggcatgtgtgattgggaggaaatcagttcccttactctatttatgaaagaattattagcaaatcattktcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatastacagtactaagaaagatttggggctctctaagcctacagtgaatatcacaatttacacctaggtggagaggaataatgctgaaatgcatttgtacttatcaggaaacaataaaccagaaacttaaaaggcatacttcattgagtcttttggagctgtaatttgacctaacaaattcattttctataaacgttctgtgttttgttctcctttaacccatgatttcagtcatcttcaaagagctctgtgagaagactggccttgattttattcaccagcttaaaaaggaaacgtttcatttgccatctttagtagacaatggttgcagtctaataattcagaacatgtaaaagaacaggaaactcctttctcctatggaaattttagcaacaaagaataatcctctctgacaatgttgttatccactaggggaaggaaggtgctgtttccaattgaggtgatggctgacatactcactatttcaccaccgtcctgttgcttaatacaatttgtacacacaactttattctacagaagcaattctcaagcttagctcagtgtttttaaaaaactgcctatgctttagaaaagtgcctagggagtttttaaaaatctagtacctggtccagtgattctgattttgtctaggacatagccagagcataatgattttttttttttttgagacagggtctcatgttgtcacccaggcaggagtgcaatggcaccatcttggctcactgcagcctcaacctccccagttcaagtgatcctcctgcctcactccccaagtagcygggactacaggtgggcaccaccacacccagctaatttttatatttttagtagagatgggtttcaccatgttgcccaggctggtctcgaactcctgagctcaagaaatctgcctgcctcagcctcccaaagtgctaggattactggcatgaaccactgtgcccagtcaagcatgaggattcttaaaaacattcccaggcaattctaatgtgttgtcaaggatgaacctaagaaaaataagcaatagggaaaggattccctatttaataaatggtgctgggaaaactggcaagccataagtagaaagctgaaactggatcccttccttacaccttatacaaaaattaattcaagatggattaaagacttaaacgttagacctaaaaccatacaaaccctagaagaaaacctaggcattaccattcaggacataggcatgggcaaggacttcatgtctaaaacaycaaaagcaatggcaacaaaagycaaaattgacaaatgggatctaattaaactaaagagcttctgcacagcaaaagaaactaccagcagagcgaacaggcaacctacagaatgggagaaaattttcgcaacctactcatctgacaaagggctaatatccagaatctacaatgaactcaaacaaatttacaagaaaaaaacaaccccatcaaaaagtgggcaaaggatatgaacagacacttctcagaaggagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccasccatcccattactgggtatatacccaaaggactataaatcatgctgctataaagacacatgcacatgtatgtttattgcggcactattcacaatagcaaagacttggaaccaacccaaatgtccaacaatgatagactggattaagcaaatgtggcacatatacaccatggaatagtatgcataaaaaatgaagagttcatgtcctttgtagggacatggatgaaactggaaatcatcattctcagtaaactatcrcaaggacaaaaaaccaaacaacgcatgttctcactcatagatgggaattgaacaatgagaacacatggacacaggaaggggaacatcacactctggggactgttttggggtggggggaggggggagggatagcattaggagatagatatacctaatgttaaatgatgagttaatgggtgcagcacaccagcatggcacatgtatacatatgtaactaaccggcacattgtgcacatgtacccttaaacttaaagtataataataataaaaaaaagaaaaaaaaaggatgagaagcactattctaaaaagaaacattatcctccatgccaacaaagagttttatagtcatttgagaattctactattagctttgtcttggcaatttccacacccattaaaaataataatattataggccaggtgcagtagttcacacctgtaatcccagcactttggtcgctcaggcaggaggatcagtggaacccaggagtttgagaccagcctgggcaacatagggagaccctgtctctaccaaaaatttaaaaattagccaggcatagtggcatgcacctatagtcctagctactccaggaggttgatgcaggaagattgcttgagcctgggaggtcaaagctccagtgagctgatgattataccactgcactccagcctgggcaacagagcaagaccctgtctcaaatgaaagaaatatctttttatatcaaatattgaatctagtgaatttaatatataaaacattgaatctagtgaatatcttttaaccaaactttaagaaataaaactttttgaaaaccaatgtgttttaaaagtggaaacatacatctgcactaaacgctgacatgactttttgggcttaatctggacactgagtgggataaacaggaataaagatgttgggttccttagattaaaagctaaagcctttctttcttgagtcctgcacagaaagatatgtaacaaaacggaaagcaaaggcagttaaattggcactcctatcagaataaagtcctgcctcagtcaatttgtaggtagatgccttagaatgatagaatgatagaactggaagtgaattgagatcagcgaatacagtgattctcaagtctagctagatgtttaaagtgctttgggtgcttaaaaaatctacatttgggctgggcacagcagctcacgcctgtaatcccaacactctgggaggccaaggcaggaggatcacttaagcccaggagtttgagaccagcctgagccacacagtgagaccytagctctaaaaaaaaaaaaaaaaaaaaaaaaaaaaaaaaaaaaaaaaaaattagcctggtgtgttggtggtgcatgcctgtgtggtcccgactatttgggaagctgaggtgggaggttcacttgagcagggtaggttaaggctgcagtgagccagtgatcgtgacactatgctacagcctgggcaacaaagcaatatcctgtctcaaaaaagaaaaaaaaaattgacatctgggtgtcaccccagcccaattaaactataatctctgggtagggcccaggcattggcattttytaaaaatccccacttgattcaaatgtgaaaccaagactgaaaacccctgggctcctgtcacctccacattttatggggaggaactagaaggaactcaaggatattttgataactgtgctcaaagtcccaccttagtaaagtttcccaatgtagtccagacagttgcatctggatccaagcagaattcactgaattaggtttggacaaaacttgtcccatgcaaaattcatactccagagtgacccatgaatttggataaccaaaaattgtccacattttaaggtcagaaataaggacattttggttgggcacggtggctcacgcctgtaatcccagcactttgggaggctgaagcaggtggaccacctgaggtcaggagttsaagaccagcctggccaacatggtgaaaccccatctctactaacaatacaaaaattaaccaggtgtggtggcaggcacctgtaatctcagctactcgggaggctgaggcaggagaatcgcttgaacccaagaggcggaggttgcagtgagccaagatcgtgccactgcactccagcctgggcgacagagtgacaatctgtctcaaaaataaataaataaataataaataaggacgttttatgaaagggaaaagtttcttctctagtattttttaattaatttctgacctcaaaaatcaaattagttcttatcccaaaacaagataaaatatttcctctacccaaccttgtsccctcaatgatttcctcacctcctgccacccacagcaattatgaagaaagcagaagacttttcacttattttccaaacacccactcctaccaggttgtcagccttcttctttaaaaaggtgctttgcactttagaagaaaaacatttgtgaggggacttttattgaagttaccatggtgaacaccactgactaaagaacagagcagatttcagccccaaagcaccagaacactggcagacacttaaggcttcaattagcgctttaaaaaaagtcatcactattttctcccactttgatttaacctattgtccccaactacagaactcttctaggtttcctacttaatgacagaggaaaagaggactttgacaaattgaaaatctcttgatgttatatgaattatttgctgaattattttgtgtataatataatctatgattaacatgaaaacaaaacacaatatcgtaatccatttttgcaaaccytgagtagtcttttttactaccacttgcaaagggtatgacttaactgctaatgccagtttttaatctcatttttaaagtcttttaatctcagttaaattaagagagatataaaaacatatgcacttttttcctttgctcaactgagattaatacatacctcacacccaaagtgaacctggagggaagcaatgccccaggctggaccctaagttccaacatgatttaggaatcttgtcatgcagggtggtggctcagactcattcttttggcctttgtgccagttacctaactgagcatgatgtttgtgccattattgatatgagggtgttatgggctgaactgtgtccccacaaaactcatgtgtcagagttcgaaaccscagtacttcaaaaagtgactctatttggagacaggacctttaaagaggtaattaaggtgaaatgaggtcacatggatgggctctgattcaatatgactgatgtaagaatttgagaagagattaggacacagataggcatagagagaaaaccacgtgaaggtgaagagagatgacggccatccacaagccaaagagagaagcctccagaagaaactgacctttccaacaccttgatctcatacttctagcctccggaattgtgaaaaaataaatctccattgtttatgccacccagtctgtgttgct

SEQ ID NO: 13294 - DNA, 15804 bp, Homo sapiens
  misc_feature (1)...(15804): n = A,T,C or G, or insertion/deletion polymorphism (see Tables 1-2)
ccaaactgctgggattacaacaagcatgagccactgtgcctggccttgatttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttgagatggggtctcaccatgttgcccgggctggcttygaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgyagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcytggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctgggaaatacacatgtgagcctggcrcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccactngctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttrggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggmgcwgtgtggttaaaggyctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccrcctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccrgaattgaggggcacrcaggattytgagcaccaggggcagaggcggccagacracctcagggaggagtgtcctggcgtccccatcctccaaagggcctgggmccgccccgagggggcagcgagagsagcttmcccatccccrgtcagtccaccctgcccygtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtgrcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatkggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggccyggcactgggggttccttctcgaaccaggagttcagcctcccctgacccgcagaatcttctgatcscacccgctccaggagccaggaatgagtcccagtctctcccagttctcactgtgtggttttgccattcrtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgycctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctccyatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctrggattacaggcgcccgccaccacgcctggctaacttttgtatttttagtagagatggggtttcaccatgttggccaggctggtctcaawctcctgaccttaagtgattcgcccactgtggcctyccaaagtgctgggattacaggcgtgagcyaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgkattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtygggggcacggggatgagctcaggggcctctagaaagagctgggaccctgggaasccctggcctccaggtagtctcaggagagctactcggggtcgggcttggggagaggaggagcgggggtgaggcaagcagcaggggactggacctgggaagggctgggcagcagagamgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggarcttagaatgtgaagggagaatgaggaatgcgagactgggacwgagatggaacyggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcagrcagaccctgggccccctcttctgaggcttctgtgctgcttcctggctctgaacagcgatttgacgctctctgggcctcggtttcccccatccttgagataggagttagaagttgttttgwtgktgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggarttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccakggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccragctgcgccagcagaccgagtgrcagagcggccagygctgggaacyggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgcccsgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcgrccagagcaccgaggagctgcgggtghrcctcgcctcccacctgykcaagctgystvagcggctcctccgcgatgccgatgacctgcagaagygcctggcagtgtaccaggccggggcccgcgagggcgccgagcgcggcctcagcgccatccgcgagygcctggggcccctggtggaasagggccgcgtgcgggccgccactgtgggctccctggccggccagccgctacaggagcgggcccaggcctrgggcgagcggctgcgcgcgcggatggaggagatgggcagccggacccgcgacygcctggacgaggtgaaggagcaggtggcggaggtgcgcgccaagctgraggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggkgtggtgtgtgtggagatggggtctggctttgttggccaggctgatgtggaattcctgggctcaagcgatactcccaccttggcctcctgagtagctgagactactggctagcaccaccacacccagcttttyattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcycttcacccactgtgaactgggtttccctgcccaaccctcattctctttctttctttctttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcycctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaaragcccccttttttaaattttttttatgtttttgagacggagtctcactctgtcacccaagctggagtgcagtrgcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcktgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctkacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaragcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaayttttttgtagagatgaggtctccctatattgcccaggctggtctcgaactcccaggctcaagtgatcctccctcttcagcttcccaaagkgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccbtaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctmcactctgcaagaaactcaaaaagggagatgaggggatcgtgggagggaggtagggagggaggagggtgccactgatcccctgaacccctgcctctgcctccagrgtgcccctccggcctcgccatgaggctcttcctgtcrctcccggtcctggtggtggttctgtcgatcgtcttggaaggtaaaagtgggatgggagaattgcggagttggagatttggaagartgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtrgggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcact

SEQ ID NO: 13295 - DNA, 81210 bp, Homo sapiens
gtcctgtttctttttctttctctcattttaatccttcttgagctttttcaaatgtgtcatgtttaaaagtggactcatcctttcttttcttttttttttgttcttctttctttttttttgagatgaagtttcgctcttgttgcccaggctggagtgcaatggcgcgatcttggctcaccacaacctccctgtcctgggttcaagatattctcctgcctcagcctcccaagtagctgggattacaggctaccagctaattttgtatttttagtagagatggggtttctccatgttggtcaggctggtctccaactcctgacctcaagtgatccgcctgcctcagcctcccaaagcgctgggattacaggcatgagccaccatgcccggcccatcctttcctttctaacccagttcctggttgtccccctgctgagtagacagcaccagccatggcctcagccaggcaccccactctccctcacagttcacattttcagtgagtgctaggctttctacttccttctctctaattcactcttcattttctccaaactcctgctatcccccaggaacagggaagcatcctctcttgctagattayagcaggagcctccctatctcctgagatcatccaggctgatcttgctaaatgttcaactctgttcctgtcttgcccctctttaaaccatatacttccatagaattaagcccaggttcttttgtcaattgttttyctttttattaattaattaattttttttttgagattgaatcttgctctgttgcgcaggctggagtgcartggcgygatctcggctatccacaacctctgcctcctgggttcaagtgattctcctgcctcagcctcctgagtagctgggaccatgggcacacaccaccatgcctggctaatttttgtatttttagtaaagacggggtttcagtgttggccaggctggtcttgaactcctgacctcgtgatctccccacctcagcctcccaaagtgctgggattacaggtgtgagccactgcacccagccttattattttttagagatggtgtcttgctgtgtctcccaggctggagcgcagtggtgcgatcatagcttacctcagcctcgaactcttgggctcatgcattcctcctgcttcagcctcctgagtagctgggaatacaggtgtgcaccaccacatctggtcaatttttaaattttttgtagagatggagtctcactatgttgtccattctggttttgaacttctggcctggaaccttccatcgatcctcccatctctgcaagcctagacatttaacatggtctagaaggcctccatgagctccatctcacctcttttttgctccttccgctccggacctttacaagttgtggccattccaaactcctttcacttctgattatctcatgttctctctcacctcyccgcccatgcaatgaggttcctccccaactagattcttattcctcttagattctcagagaagccttccctgaaagaagccgtctcccatctcccagattgggttaggctcctcctgtgtgctgacttcattgtctctctccaacattgcttagaacgctaagttgcaactttatgtctaattgattgctccactagtccataaaatctaggaggaaagggctgtatcctkagcccttgacacatggccttgtacatcttaagtytgcatatgaaccgctttatttacctgggatattatcttacttaatccccaagacaaccctatacgttgtgcatgattattccaatggtcattactgttattttaaatagagatgggggctcactatgttgcccaggctggtcttaaactcctgggctcaggtgttcctcccaccttggcctcctaaagtgttaggattacaggcatcagccaccatgcctagtcgattatgccccttttaatggatgagcaaagagtcgaggttccactggttttccactgcagtgtctctgctgaaggattaaaaaaaaaaaaatcacagggctgtgctggactcctgggacttccagaggacaagtccctctcttcagtgaggctgacctacacagagccagccctccttcccctcccagccacagctgtgtgttggaaagctagaggcctgggcccctaataaagagcagacctcccaatctcctcgttccttccccctcccctcatatggtttttcaaattaaaagcaactaaaaccaaagacctaaggagcaggagagggcagaggcacaacaacatccctaaactgaggaagggggctctctagcgagggagggggtatccaaaagccagatccagagggttccagtcctaccagtctgtcccaggctctaaggagtgtatggcccaccgggctgggctggaccaggaaacaagctcttgtcctcaggtctgtaaacaggctgcgttgttaggaaccctctgcttctacttcctgaagagcaagccccccaaacccagaagagaggctgcaccttgagatccagccagcaaggtgggtgcggagtcctggggagggaactttcacctcaagctgcacagacccatctcgatctttttagagaattcctccttttccaggactagtgccgttctgaattctgagcgtgcaaagagactccttagagctagcttccgagcctcagctggggcagaccagaggccagggcgtctctctgtctgcggggaccccccacatctgtgcgtcacctccaccacctccgggcaaaggacccttcctcgctggacccagggaggcggctattccagatgcagccaagggttaaagggggtgggagaaggagcagttagcaccgttttcttttgcaaaccaccaaacgggcccttcattttcaaattgtgaagccagaaacatcccccgttcccttgccccgcccatcaccatttgaaaaaaagaattcacaagtttaaacgtgattttcacaactaacggctttgataactgttaaattcgtacggcttctagggcaaacggacctgaattcttcaaggaaagtagaattggcggtggagctggggggcagaggaggagaagacacaaaaagccaactcagtgggaagcgccctcaaagccaaaggtgtggcgctcggagctgtggccgccctcgcccgggagtcggggccaggagaacgggccctggaggcagggcagggcacggcgagattttgcttttgtttttagtgaccattttgatctggttgtaaaaagtttacgaggccttctttttgaaagtcagctaatcgactgcacctttttatacccttgccctcaatttcatgtcgcctgctggcctagacgcgcaaggcggaggacagaactgtcacagtccctacccttttctcccaacttcycggcccggctcaattcgggagttgggcctccttcctctcggctcgcagcctccccgactcccactttggggagaaaacccacattcttaaccccttgataatccctcaaggaaaaaacaaaacacccaaccccaagaggtgaaaattagaatccgggcgcgggttgagatcttgcgcaaaactggccaagcccagtgcatgtcgctcctctcctccgggtacataataggggggctggggcccttccccccccccccccacaaagggggcccagtggggaagcacaagaaagggggagaaaagacccgcacccccccctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggcttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattccgcactctgatttttggggggatcgtttgttcccgctcattttctacaaacattacggtatcctgttagcattccgaacarggggctgttcatatatttgccttcaatgatttcctgaaggracatgtggaagtaatagcgagcggtgcagtcacccaagctgaagatgcacgagagcgggtcgcgtagaagaactgsggcaatgggacccccagcgcagccccaggcgccctgttttcgaggctgacatcccaagatcctgtcctggttaggcacagcaccgcgcccgttggagtacttctctgtgactctcccctgtccactgcactgtgtccaccctcctggtgaaggaggagacggctgttggacatgccagtcccaacctggccactttggccattttcagagtgcgtgtgttggggtggggttgagggagaaggatgaaggatgacccccaaccccaacaggagaattcaaaaatcagagagcgatgaaggtgaacgcgctcccctcccccgctgtcgctgggaagccccactctgcccaggtctggttcctggagcatcagcgccccctttccctcgccggcaggatcgtttcctcccgacactggcctctcgccttgggcgcaggrtttggggctcagctgtcaattccaaggaattcgtagggttcgacccamgcggcgggagggaacggagggagaatcaaaaggcatcctcccccacgacgcggaggcggtggtacgattcctcaaacgcccaagcttgagctttttttgtatgcgagatagaakccagggcaacctcgcccagataaccccgaaaacaaaggcacgaccagataagtgacttcaagggagtaaaggtcgttctatcggagaacgttccaaacctacacagaccctcttttctttgtaccgtatttcagaccacccagtcttgtacacacacacacaccacacaaaacaaaaacccatcattgtcatattggactcaacagtttgcccaatcctattaaataactagcaactatatagcccttcccctaaaagacccctagttcaaaacggcgcaaccgcttggagatttctcccgagggccctatttctcgttgggccgagtttgtagaagggacatttcttgattctagatttatattctctctgggtattaaatgcaattttgtatgttccttttcttcttttcaaagagaatacaaaactatagcagtctaagaaaataaccccaaaatggggaggcaaactcattctggaaatgatgggctgtttgtagtttcacaaaacctctttcccggcagagcaccaacacctcccccttccaccaccccccatcccatctggtctgcttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaaggtaagggaaaagaaaaaatgattttttgtttataagggaagtccctgatcagactctgggactggagaaagcgaagtaacttcaaactttgggcgacaagaaaaaaaaaaaggagctggattccagttgtgtgtccagagagtaatttttttttttcggaataaacttcacttggggacgggtgggagataaccatagagttagaaagtctaggtattttttttaaacacacattttccagacctatttttaaaaacaatgtttttctaacaaccctatggcctcccaaagaaattgtttaggcttacatttttgaggtttcttttgggagtgggggtggtgttcgtgaatactgggccgaacaccaaggaactgggggtggaggcagaggtgtttgccctcttcttggcagtgggtcctggaaggcgacaggttttaaatgagtgttttcattcctcgcctgcggtttggcgggacagcgctgcagcccatggtgtggagcgcggctgggggaccagggggaggtggggagaggggagcgtggaggggagcgtggaggggggcgcgcgaaggggttgcggggcgcaggaggcgggctgggctcggctggagaccggacctcggtgttggcctacagcacagggagccggccgaatgcgcgtgattactggacggcgctgctctgggagagagtcggggccagatttggcgcggcggtgaggcggctgcgggacaagcagaggcgcgcgggcgtgggcaagggtttggggcgctctggagcggtttgttgggtcagtgaggtgccagggagagcgggtgcctgccgggcagtgtgctcgggttgcacgccctakcgcgggggcgacagcggcggcgcgggcgggcggtctggaataatgacaaacacatttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcaggtaagacagaaaggtgggaggtaaaccatattctccctccgggcacccgagccctggacaccccctacccggcacccttctccgcgcgggggtgcgtggcacttgccgtctgagctcgcccagcgctgctcggtcctctctagttggccttttttccattcctctccctgccggcttcagagccgtctgtgcgtacttctccttcctctgctgtctacccccatggaaaccagatttacacacgaaattaactccgcccggctgcgcccagggagcgggcggcgtccatttggcattgaatatgtgggatcagctgttctattccgggagggtgtcggccaggtcggagcgacgagtgtggcccaacccgagtacgttgccagagggagccaggagcctgggccgggccaggtgtgcgagagctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatctycctgggtgggaggcaagcatggatggggcccmtatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcycatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccagsctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctgtcgcccaggctgaagtgcagtggtgcgatctcggctcactgcaacctctgcctcccaggttcaagcgattctcctgcctcagcctcccgagtaactgggattacaggtgcccgccaccacgccaggctaatttttgtatttttagtasagacggggtttcaccatrttggccatgctggtctcgaactcctgacctcaggtgatccgcccacctcggcctcccaaagtgctgggatttacaggcgtaagccamcgcgcccggccaggaacggttcttaaatgccgagagggcgcatgctagctctcctcagcattcccggtgagccgctacccacggccgtgcggctctcgtgcccataggaggcgctggcgagckcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctctgggtcccggggtcagaagccggacagtggcgggggctggacagtccgagcgcagagcctcccgggcgaagtctgcgcgcagcactcccggctgcgctgtcggggaccaggagcctgggctgcgggcgagctagctggcgagccgggtaagattcgcggggctgtcgcgccctctagtgggctccggggacgcatcccgctttccccagccccgggcggtcggcgccgctatctcagtggagcgcagcgctggaaccccgggggcccggagcggaggctaatctgggtcacctttcccctcctccgggcagccagtggactcctcgcaggctctgtgtgggcccgggaggcgccgggtggacgagagggggccgaggtctctgggtttggattgagaatgggacgtccttgtaattcaatgtgggagaagcaggggagtgtggaggaggacgggtcccgtgcgttcttggggggcaggcgccgtcttctgcgttccagcccctcgccagctcccttgccccgcgggcggcctgttgctgtttgtttgttttacgaccctgcgttattgtgcaacggtaacagtcgtttccaatcagctgcgcggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatgatgatggggatgatggggagatgtccccgaattctcctggggtcccgaggagatttagccattttcaacagcagttttcctatttctgcttaaaccccgcgggctttcaactgaggtcaccacgaaagctaaaagtacaacctaargaaggaagagrctggaaattaacatttggggtagtggagctcagaattcctcgcagcggcgtctgtgtcgcaacccgtggacgcacgtccttggaccaacactgccatctgctggccactcgtaagaactactgcgacccgctgtgagaatgggcttcgcggagaccattaggaaggtgctttattttttattttttatttattttttgctcagtaggaccgtaataggtgactgattttcttttgctgtgaggctacaagaattgctggaagacaacatttttatttcgtggaaatttgtgttgtgtttctccttggttgttaatgctttgcatttacatrgtgaacatcttattatcagagctggcctgtgaggagggtagtgggggggcattgatgttcccgtttctgagtgaggagacctatgtcggggccttggtgacctcaagccgaatgctcaaactgctactgctactcctaaggttgtgccattaggagtcacacccgtttggtgatattcaaaaggatatgtcattttattctcccgtggttaaatatatggtgagaggagagcaggcatgtttatgagcccagattgtcccataaaaggctcctgtttaaaaacactccagccccctcccattactggaatgtctgatggagctccgggagatcaaaacaacaaaacaggctctggtagggtgcagaggtcctggtaaacacaccctctgctggaaaacagggagaagtttccaccagtgtagacctgcacttggtttgcctgggctgaagttaggagactgcgtagaaaaaggaaaatgtgtaattttcacagttagaattaacttaggagagctgaaattaactgagcctcggaaatctgaatcttgaagtcaccagtggcttttggggctgtgagagagtctcctgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctgaatcagagttcagatccatgtctccaggaggtaggaggtgcagggcaagtcatgtggcttctggggcatccctcactttcttagttaaggagaagttgaaggagccgatctaaaatatcttgggagtctgcagaaaaagtcgtgaaaatcaaagcactttcaattaaactatataatttagtccttacaagaatgccacagggcaagcaaccagtcaggccttggtagtcgtgcttcctagaagaaaagactgaggttcagagagttggatagagtatcagatttgggatcagtggctagtccaatgtgatttccatcctttcttctgagagaaagcataagaaggccaagaggatggtggaaaagcacaagtcacctgcctgagagtcaacagggcggggggtctctttctcagtttgttcctctaagttatggcaaatgttttttgagctgtgattattgagaatgggggctgaagttcaacatgtagttggcatgagggaagtaattatgattgaagaaaagatttgggtgaaatctagtgttcttccctgcaaagggggttgttctcacggattcttatggtgccatgtttctcagaatttgtagyttcagttacttatatttgcacacctgactttagatgagctccagaatagcagttactaattaaggatgagcatttagagtagataaaagtggcaggaacagcaagactcactcccagagagcctcactacaggwctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgygggtgaatcacgaggtcaggagttcgagatcagcctgaccaacatggtgaaaccctgtctgtactaaaaatacaagaaattagctggccatgatggtgggcacctgtaataccagctactcgggaggctgagacaggagaatcgcttgaacttgggaggcagaggttgcaatgagctgagatcatgccactgcactccagcccaggcggcagtgcaagactccatctaaaaaaagaaaaagaaagaaagaaaaaagaaaaaaagaaagttcacaaacaggcctgatttctacccagggaaccactgttatcagagattggggtttggaatcttaagcaacaaacacatgtttattctcttccttcctgatggcttgctcagaggacctgtttccattgcccactttttttttgagacagaatcttgctctgtcacccaggctggagtgcagtggcgagatcctggctcactgcaacctctgcctactgggttgaagccattctcctgcctcagcctcccgagtagctgggattataggtacctgccgccatgcctggctaattttttgtatttttagtagagatggggtttcatcatgtcggccaggatggtcttgaactcctgacctcaagtgatctgcccacctcagccttccaaagtgttgggattacagatgtgagccaccacgcccggcctcattggccactttatatgtcagtaaataatctttcctggcagagggtccactgtatctggaggcactgaaggaaatctgggagtgtctggccagggcaaagcactgcttagagcttgcacaggaaaagcagtgagcccttcttttaagctggagaaagctttaaagatgcatctttggcaagtcttgccaaagaaatatgggttctaaatgtgataaaaccaaagacatcaagctggctctggaggccttgtttgaagtttgctgagtggattgtcagtgggaggctgatatttatatgtacaaacacacaagcattactgctaattgtggtaaatcaggctggccagcctggctctggggcccactgtgcctgccaccgcagcagtgtggaagccttgcatcccaggcacatgtcaggatcctcggaggccatcagccagccagcattgtgtgaattgcatttgggttcacagcactgtaattgtgtttctcctgctgtggtgagcaaaggaggaaaatggaaggaggaggtataatttgccctaggaaatagtcaggcaagtaggtggcacacaggggtgggatatggctaaaacactgaccttcccttgagagagaccatatggtgaagtggagagggcatggcgtttgtatcacacgaccttgtgttcaaatcctggctctgtcactggctgtgtgactttgggtcatttgcaaaacctctctgagcctcaactgccacttcttaaaatcagctctaagtaatcacagggttattcttcacaaacacagcatgcacatgcaaactttggcttagtaaataatggtttctccttctcttactttgttttctacataccccactccccttcctgtgaggagccttccacctttttctctgtgttctcttcctctcccattttcctggtagcattcaataaaacagaaatctgatttctgcaaagtaggccaccttacggtagaaatacatgattaggccccaccaaaaactttgattaggctattatcttctggatcctggatcccctccaaccaaaccaaacccaactagggctaaacacagcaatatatgaatacattgaatttctctctcactctttcttttttttaaaccagtttactcaggaatcacatgcacacatattttagcttccaaagccaatgatggaacaaattgtgtcccattaggctcactccattgtatgagttagcatcagaggagttcataccagagtgacttcatcttgaatagggcctaggtaagaagaggatgagacctgctgggctgcattcccaggaggttacacatttgtagtcacaggagagaaaggagttggtataggagttgatagatacaggtcataaagaccccagtgataaaacaggttgcaggccaggtttggtggctcattcctgtaatcatagtactttgggaggccaaggcaggaagattgcttgagcccaggatttcaagatgagcctggacaacatagtgagaccttgtctctacaaacaataattttaaaaacatgagctgggcatgatggtgcaggcctatagtcccagctactggtctgaggggcagttgggtggcaggctgagatgggaggatggaggctgcggtgagctgagatcaggccactgcactccagcctgggtgatggaataagaccctgtctcaaaaatagataaataaataaataaataagccagcaaaaccagaatgcagtgaagaagctggccaaaacccaccaaaacgaagatggtgatgaaagtgacctctggtcatccctactgcttattacacactaattataatgcattagcatgttaaaagacactcccaccagtgccatggcagtttacaaatgccatagcaatgaccagagatactctatatggtctaaaaaggggaggaaccctcagtcctgggaattacctgtccctttcagggaaaactcatgaatcttctaccgcttgttgagcgtataatcaagaaataactataggtatactcactcaagcagccatgcagttgctgtgcccatggagtagccactcttttattcttttactttcttaatatatttgctgtcattttactcttttggcttgctcttgaattccttcctgcatgaagccaagaacctttgtgacctcccaggctgaaccccaattttgagttccaccctatgacatcttttctggtgaccaatgaagggacaatggtaacctcccgttgactttaaattaaaactgattggcactgtttgggcttcaccggtgggtgagtctctccttgcccagattcaacttgctaacatttttttctcttcaattttggctcctttgtccttcctaatgttcttcattttggacagatgggaaagtggctgtgaggcctctggcttagcagcctgatagcagcctcctgttgtctgggtgccccagatgggagcacgcctggctggccacatcttttgcaacccaccttgtcatcccttctctgggaccttttctctttagtttcttttttaaaaaaaattttaaattatttatttatttatttatttttagagatagcatctcgctgtgttgcccaggctggagtgcagtggcataatcatggctcactgaagcctggacctcactggctcaagtgatccttccacctcagcctcctgagtagctgggactataggcatgcaccaccacgcctggctaaattttgtattttttttgtagagacggggttttgccatgctgcctagactggtcttgaactcctgggctcaaatgatctgcctgcctcagcttcccaaggtactgggattataggtgtgagccactgcacctggcctctctttagtttttaatgactggctgtttgacttctctgctcttcaggctgaaattcttatttcatgtttgtagtctttgccttggctatttggcaactgtttaaggcaagacacttggttttgagagttctcccgttgtgttgaccctgggacaccagggtcattgttctgtagctccaattatgttaggtctcatgcttttgggtttcactattggccaccccccagatgctctggggtttttggcatttggtgtggggacccttgttagctgatactctgggcttttcggcatttggatgctccagggtgtttggcactgacattcccctctagcattgtgggttagagtcccacccaggggaaatcttggtyttgccttttcttgttttctactctaaagttatcattttctataaaaacattttcttttcttattgtcactttgtttaatgctttgctccaggaggtgggaatttgcaggggaaaataattgggctctccctatacttagaaaaacttctgtgtctagtagagatccttgttagacaaagggacagtggtgagtcccagagaactcgtcactagggtgccttttaggcaattggagcaaattcaaattagcaaactaagtttggccatttggataagtcccagttttgtcagggaaataatttgggtccagctatcttttataaaatagtgcgtttgcgttcctacattatggctagagctcaaagataaaagctattggatctttgtttatgtgtgtgtataaatgtctagatgtgtttatgtgtatgtacatttattatgttatatattgtatctacagggtaccaaattggcttataaataaaagagtgctcataaaaagagtaaataagtccaagcatttctcaagctcatgtaacttaagtttactaaaatttagagttactaaaaattcatatataactctgtataaatgtgccaaagaagatatgctcttagtgaaaataaattctttttggccaattcagatgtcatttatatgtggggtttaaaatatgaatttcgaaagaaaataaaaacaagtagaaagaaataaaaaacaataagcagtggagagagatgtgaggaaagttatgaatatgaagacgtatttttggtaaggaatgttataaagaaattttatgagaaaggatcttatatgataaattcttgtcctaaggtagaatgactgattgtttagaaaagaaggaaatataggacaagtcagaaagtccaagcatgttgtagatgacctatgtaagtcacgataaagtttatacaagagaatttattaaaatttagatgtaattagccataactgaaaggaaawttatttatttatttatttatttatttatttatttatttatgatttattttgagaaggagttttgctsttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacagtggttgtttcaggctgtggctcaatagctaagcctttgttctttcatggtggtggcctgggttcagttcctggcttagagaatgagaggtttccagtttgctacttctgggacttttgtcatttatttattctttttgtctccatcgacagcttctgattttctcacttgaatttttttttctgtgagctaccttaagggtaatgttggatcttgtaaaaattgcttgccatctctttggagatacctcttgtgtccatggttaagttataaccttggttaaggcctgttggtttcactagggaaaatacctttaaaaaaaggcttaaaagccagagatgttggctatttgtcctggctagagtctggtattaagggatttaaaaggattttttaaaggacctctatagttataagtcagcttaattaaaaatggatattccatagtcatatttatatatatatacacacacatatatatgtatgtatgtgtgtatatatatatatttaaaagacctgtatgatttttttcttcttggaacttatttttttgagagaaagtgttttgtgtgtttgttgtttgtttttcttctcagtggactgaattatttctccattctgtctttttaccccctttaatgaccatattagaggacctaagataatttctgacagcctgggactccttgggaggaaacagaaggtgccacagacctcgttttgggagaaacctctgttttcctcatggaaccccaagagctgtaagcagagagttctccctcagaatccaaggctctgctctgtttacgtcacattacctgacctttgtgacttttgggggcatcagaaattactttgcattatgagggaacctttagcattggtgtgtattacctaggtaggatgtgtacttttagggattgcagttgcttacatgagtggttattactacagaccaatacttctttcttctcacatttaaatgaaaaaaaagcatgctcttgggcatccacctatgaatggaggatgggctgatttgctttaggttggccaccagcctttggggaacatcgttgcagtgaaatgcttggtgaaagcattgcactgtctgatcgcatagtgcacttctatgcacttctgcctgatgtcctaggctcaacacctgctacataattaagatcacttacttatcaggtttttaatcaaaatgaaatgttgctaagagttaacattatagcatatgtaattgagattactggagaaagttttacctacaagatatgtaaggaaagcaaaatgtgtttttggtaaaagattataggaaggtgtgccagtatagttttttattttgcttactttaatgggttaaaggattgttttaagtttgataggagaaagctgaagcatgagcaagttgtggaaggtatatgaaagattaacattttaaaagaaattctgtgtgtaaacattggctaaagttaaaggaggaggttggagccaagatggctgaataggaacagctccggtctacagctcccagcatcagcgatgcagaagatgggtgatttctgcatttccatctgaggtatcaggttcctatcactagggagtgccagacagtgggcgcaggacagtgggtgcagcgcaccgtgcgcgaaccgaagcagggcaagccattgcctcactcggaaagtgcaaggagtcagggagttccctttcctagtcaaagaaaggggtgacagacggcacctggaaaatcgggtcactcccaccccaatactgcgcttttccgacgggcttaaaaaaaggcacaccaggagattatatcccgcacatggctcagagggtcctacgcccacagagtctcgctgattgctagcacagcagcctgagatcaaactgcaaggcagcagcgaggctgggggaggggtgcccaccattgcccaggcttgcttaggtaaacaaagcggctgggaagctcgaacagggtggagcccaccacagctcaaggaggcctgcctgcctctgtaggctccatctctgggggtagggcacagacaaacaaaaagacagcagtaacctctgcagacttaaatgtccctgtctgacagctttgaagagagcagtgattctcccagcacacagctggagatctgagaacgggcagactgcctcctcaagtgggtccctgacccctgacccctgagcagcctaactgggaggcaccccctagtaggggcagactgacacctcacacagccgggtactcctctgagacaaaacttccagaggaatgatcagacagcagcatttgcggttcacgaaaatctgctgttctgccgccactgctgctggtacccaggcaaacagggtctggagtggacctttagcaaactccaacagacctgcagctgaggatcctgtctgttagaaggaaaactaacaaacagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacctccccaatctagcaaggcaggccaacattcagattcaggaaatacagagaacgccacaaagatactcctcgagaagagcaactccaagacacataattgtcagattcaccaaagttgaaggaaaaaatgttaagggcagccagagagtaaggtcaggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgccctaaaagagctcctgaaggaagcactaaacatggaaaggaacaaccggtaccagccactgcaaaatcatgccaaattgtaaagaccattgaggctaggaagaaactgcatcaactaacgagcaaaataaccagctaacatcataatgacaggatcaaattcacacataacaatattaactttaaatgtaaatggactaaatgcttcaatcaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactatcctaaatatatatgcacccaacaatacaggagcacccagattcataaagcaagtcctgagtgacctacaaagagacttagactcccacacaataataattggagactttaacaccccactgtcaatattagacagatcaacgagacaaaaagttaacaaagatagccaggaattgaactcagctctgcaccaagcggacctaatagacatctacagaactctccaccccaaatcaacagaatatacatgtttttcagcaccacaccacacctatcccaaaattgaccacatagttggaagtaaagcactcctcagcaaatgtaaaagaacagaaattataacaaactgtctctcagaccacagtgcaatcaaaccagaactcaggattaagaaactcactgaaaactgctcaactacatggaaactgaacaacctgctcctgaatgactactgggtacataacgaaatgaaggcagaaataaagatgttctttgaaccgacgagaacaaagacacaacataccagaatctctgggacacattcaaagcagtgtgtagagggaaatttatagcactaaatgcccacaagagaaagcaggaaagatccaaaattgtcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacgcaaaaaaaaaaatgataaaggggatatcaccaccgatcccacagaaatgcaaactaccatcagagaataccacaaacacctctatgcaaataaactagaaaatctagaagaagtggataaattcctcgacacatacaccctcccaagactaaaccaggaagaagttgattctctgaatagaccaataacaggctctgaaattgtggcaataatcagtagcttaccaaccaaaaagagtccaggaccagatggattcacagccgaattctaccagaggtacaaggaggaactggtaccattcyttctgaaactattccaatcaatagaaaaagagggaatcctccctaactcattttatgagggcagcatcatcctgataccaaagccaggcagagacacaaccaaaaaagagaattttagaccaatatccttggtgaacattgatgcaaaaatcctcaataaaatactggcaaacagaatccagcagcacatcaaaaagcttatccaccatgatcaagttggcttcatgcctgggatgcaaggctggttcaatatacccaaatcaataaatgtaatccagcatgtaaacagaaccaaagacaaaaaccacatgattatctcaatagatgcagaaaaggcctttgacaaaattcaacaacccttcatgctaaaaactctcaataaattaggtatgtaaatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggacgttctggccagggcaattaggcaggagaaggaaataaagagtattcagttaggaaaagaggaagtcaaattgtccctgtttgcggatgacatgattgtatatctagaaaaccccattgtctcagcccaaaatctcctgaagctgataagcaacttcagcaaagtctcaggatacaaaatcaatgtacaaaaatcacaagcattcttatacaccaataacagacaaacagccaaatcgtgagtgaactcccattcacaattgcttcaaagagaataaaatacctaggaatccaacttacaagggacgtgaaggacctcttcaagaactacaaaccactgctcaatgaaataaaagaggatacaaacaaatggaagaccattccatgctcatgtgtaggaagaatcaatatcatgaaaatggccatactgcctaaagtaatttatagattcaatgccatccccatcaagctaccaatgactttcttcacagaattggaaaaaactactttaaagttcatgtggaaccaaaaaagagcccgcatcgccaagtcagtcctaagccaaaagaacaaagctggaggcatcacgctacctgacttcaaactatactacaaagctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattctttatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacatagggcatgggcaaggacttcatgtctaaaacaccaaaagcaatggcaacaaaagccaaaattgacaaatgggatctaattaaactaaagagcttctgcacagtgaaagaaactaccatcagagtgaataggcaacctamaaaatgggagaaaatttttgcaacctactcatctgacaaagggctaatatccagactctacaatgaactttaacaaatttacaggaaaaaaacaaacaaccccatcaaaaagtgggcaaaggacatgaacagacacttctcaaaagaagacatttaagcagccaaaaaaacacatgaaaaaatgctcaccatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtgtaaaagtgttggtgggactgtaaactagttcaacccttgtgggactgtaaactatttggttggtgggactgtaaactagttcaacccttgtggaagtcagtgtggtgattcctcagggatctagaactagaaataccatttgacccagcaatcccattactgggtatatacccgaaggattataaatcatgctgctataaagacacatgcacacgtatgtttattgcggcactattcacaatagcaaagacttggaaccaacccaaatatccaacgatgatagactggattaagaaaatgtggcacatatacaccatggaatagtatgcagccataaaaaatgatgagttcaggtcctttgtagggacatggatgaaattggaaatcatcattctcagtaaactatcgcaagaagaaaaaaccaaatgccgcatattctcactcataggtgggaattgaacaatgagaacaacacggacacaggaaggggaacatcacactctggggactgttgtggggtgggggtagtggggagggatasctttaggagatatacctcrtgctaaatgacgagttaatgggtgcagcacaccagcatggcacatgtatacatatgtaactaacctgcacattgtgcgcatgtaccctaaaacttaaagtataataataataaaataaaaaaatttttaaaaaataaagttaaagggatattattattattatttttgtaagttaaacattaggattaaaaagcacaacagagttttctagagcactgatctactctgtaacagaaaattgtaaagggtttaaaaggtttatgagaatcttaccttatggtcaaactggttaagattgggaagatttgtctataaagttttattaagaattgggtttgacattaatactacactaatgcaaacgtgaaatgtggctttctctcttgaataagattttcatgtattattacaagataatgaaagatttttatttgctttttaaataaactataggaaaaataagggagagaaaagtgacagatcatttggaaacccaagtctcccctatatcaatgagtaaaagtttttacctttttgaaatctttgagttatcattttggctaaataaatgctttatggtgacctgggattctattttgtaatatcaactgtttaaaccttttgtatttgacaaacgttccaaactgaaattctaatgtaagtctttttctgacctgattagtccttctagatattaggtcccctaaagtccaaaagtgacatatttggcttattagatatattaaaatcatacaggaagcactttcaaatataaaatgctatttggctttctttggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagrcaattgtcttgttttaatccttttcaaaaggtggtttataatcagctataggactctgatgggtactctaaaatgcaagcctctgataactttgaaaattgtgccattggctgggcatgatggctcacaactgtaatcccagcactttgggaggctgaggcaggcagatcacgtggggtcaggagttcaagactagcttggccagcatggtgaaatgccatctctactaaaaatacaaaaatcagtcaggcatggtggcatgcacctgtaatcccagttactcgggaggctgaggcaggagaatcacttgaacctgggaggcagaggttgcagtgagctgagatcgcaccattgcattccagcctgggcaacaagagggaaactccgtctcaaaaaaaaaaaaaaaaaaaaattgaaaaagaatattgtgccattgaaacagaaaagaaaacacaaataaacttccaggattctcatagaaacttaatatattcataaggaatgtggcccaatatcaggcaaaacaagagttaacagcatggactaaactaataaaagaccaaaacaatcttttartgactttttgcttaaaacattgcatatcctttctgttttgcttttcagagtcaagaaaacttttcctttggaaagtatttactgcttttaacaattgaaaaaagtatactactatggacaaaatttggagcatatgtctttctttttacctgatttctccagaatttgaaaactatttgggagtattcttaactaatagcaatatagttatttgyctaagtgcagtaagaatcttttcttttgtaataggacacaattaaagaaactgcttattttatgaaggctttgactagaatggtgtgctttcagatacaaacagactgctttaagggatcaaagttgacttatagagccaataaaagccactatggaaaactggccttattctttgtctatgcagtctctgtatggggttcctgacctgtggtaagtgaagaatgtcactttctgacaggcccaggagccccaagttatcttgggacatcaagaagaaaggaatgcacccaacttatacaggtatttgcaggcacagataaatctgtggctggctcaaggctttaagaagcctaatgtgagattctttttaaattaaatttccatcgaaaccaattttaacaagagcctatgtggcaaataattatttttgctgcactttatacaaataatcaggccaaatttcataagattaaaactttatggcaaacaaatttgtcccactatgatttgtctttggtaaaaatggaagctagagagagaatttgtttcaaaaactatgatayaccagttattagattctagtctcgtctgttgtttttgagtttcttctgcaatttaggcagaccctgcttattcctgagaatcaaccagtgatctatggctgttgctcagaagaaataagagggatggctaacgtaaagatctggattagtattctaattctaggcatgtattagaattggctagtgaccccatatcagcttggttttaacaattacccagttcatggaaagccttcttatttagtttacttgggataattgtgctgattttgttttactgttgtggaatatattgctgttgtcctctttgtgtaggaatgcaggaaaagcttacttaacattttcttaaattgaacacttattaatcttccagatttcaccttttgtcagaactcagagttatgatttgtcctcactgtactgacaacaggctctggtagggtgcagaggtcctggtaaacacaccctctgctggaaaacagggagaagtttccatcagtgtaagcctgcacttgggttgtctgggctgaagttaggagactgagtagaacatttgctgcagaaaaaaaagaagatgtgtaattttcacagttagaattaacttaggagagctgaaattaactgagcctcggaaatctgaatcttgaagtcaccagtggcttttgggactgtgagagagtctcttgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctaaatcagagttcagatccatgtctccaagaggtaggaagtgcagggcaagttatgtggcttctggggcatccctcactttcttagttaaagagaagttgaagtaatcattctgaaatattatgggagtctgcagaaaaagtaatgaaaaccaaagcactttccattaatctccataatttagtccttacgataatgtcacagggcaagcaaccaatcagaccttactagtcgtgcttcctagaagagactgaggttcagagatttggacagagtgtcagatatgggatcagtggctagtccaatgtgatttccatcctttcttctgagagaaagcataagaaggctaagaggatgggggtaaagcacaagtcacctgcctgagagtcaacagagcaggggtctctttctcagtttgtttctctaagttatggcaaaagctttttgagctgtgattattgagaatgggggctgaagttcaacacatagttggcatgagagaagtaattatgattgaagaaatctagatgaaatccattgttcttttctgtaaaggggttgttatccctgattctttttttcttttttcttttttagatggagccttgctctgttgcccaggctggagtgcagtggtgtgatcttggctcactgcaacctctgcctcctgggttcaagtgattctcatgcctcagcctttccagtagctggaactacaggagtgtgccaccatgcccggctaatgtttttatttttagtagaggtggagtttcaccatgttggccaggctggtcttgaactcctgacctcaagtgattcacccaccttggcctcccaaagtgctggaattacaggagtgagccattgtgcctggcctgttctcactgattcttatagtgccatgtttctcagaatttgtggcttcaattacttatatttgtgcacctgacttttaggtgagctccagaatagcattactaattaagaatgagcatttagagtagaaaaagtgacaggaacagcaagactcacttccagaaagcctcactacaggtctaataggtgaggaaagtccccatctttcccatttttcttcattacctccctgtggggcaagcactgccattatgcatgagtaaactgtctgagttatagataagtaatgacatgaaacttcacaaacaggcctagatttctacccagggaaccgctgttatcagagaagggagtttggaatcttaagcaacaaacacatgttgattctcagtatttgcctcctgatggcttgctcagagagcctgttttcattgcccactttatatgtcagtaaataatcttccctggcagtgggtccaccatgtctggatgcacacrgggaaatctggtggggtctggccagkgaaaaacactcctcaggttttgcaggaaaagcagtgaacccttcttttaagctcgagaatgctttaaagatgcatcattggcaagccttgccaaagaaatacgggatctaaatgtgataaaagccacgacgacatcaagctggctctggaggtctcctttgaagtttgctgagtggattgtcagtgggaggctgatatttacatgtagaagcacacaagtgttactgctaattgtggtaaatcaggctggccagcctggctctggatcccactgtgcctaacaccagccctgcatcccaggcacatgccgggctcctcagaagcgatcagccagccagcattgtgtgaattgcatttgggttcacagcactgtaattgtccttctcctgctatgaggagcagagagggaaaagggaagggagggttgtgtaatttgccctaggaaattgtgggggagggacaggcactgggccgggtggggggcggtgcgacatggctaaaacactgaccttcccttgagagagaccatatggtgaagtggagagggcacagcttttgcatcacacaggccttgtattagaattttggctctgacaccagctgtgtgaccttgggtcatttgcgaaacctctctgagcctcaactgccccttcttaaaatcagctctaagtaaccacagggttattcttcagaaacacagcatgcacatgcaaactttggcttagtaaataatgatttctttttgttctatctactccacctccctttcccattagaagcttgctacctttcactctgtgttttcttcctctcccattttcctggtggcattcaataaagcagaattctgatttctgcaatgtaggccaccttagagcaaaatacatgatcaggcaccaccaaattaggctattatctactggatcctgtttaaccaacccaaacccaactcaggctaaatacaggaatacaagaaaacgctgaatttctcccctttctttttttttttttttttgagacagagtcttgctctgtcacccaggctggagtgcagtggcgcgatcttggctcactgcaagctccacctcctgggttcacgccattctcctgcctcagcctcctgagtagcggggactacaggtgcctgccaccacgcccggctaattttttgtatttttagtagagacagggtttcaccgtgttagccaggatggtctccatctcctgatctcatgatctgcccgcctcagcctcccaaagtgctgggattacaggcgtgagccactgcgcccttccctccttttttttttaaaacaacaacaacaacaacaacaaacagtttattcagtaattatgtatacgtattttagcttccaaagtcagtgatggaacaaattgagtcctattaggcccactccattgcatgagttagcatcagaggaggtcaaactagagtgacttcatcttgaatatgggctaggtaagaagaggatgaggcctgctgggctgcattcccaggaggttaggcatttgtagtcacaggatgagataggagttgggtaggaatggtttcataaagaccacaggatgcaagctgggtgtggtgccttatgcctgtaatcccagtactttgggaggccaacgcaggaggattgcttaatcctaggagttcaagaccagcttgggcaacatagtgagacctcatctctacagataatttttattttattttattttatttttttgtgatggagtcttgctctgccgcccaggctggcgtgcagtggcatgaccttggctcactgcaacttctacctcrggggttcaagcgattctcctgtctcagcctcctgagtagctggaattagaggcgcacaccaccacgcctggctaatttttttgtgtttttagtagagatggggtttcaccatgttggccaggctggtctcgaactcctgacctcaggtgatccacctgccttggcctcccaaagtgctgcgattacaggcatgaaccaccgtgcccagcctctacaaataattttttttttttttgaaatggaatctcagtctgtcgcccacactggagtgcaatggtgcgatctcagctcactgcagcctctgcctccctggttcaagcgatttgccttacaaatgatttttaaaaaatgagctgggtgtggtggtttcacaagatacgggtgataaagaccccaggatgcgggccgggtgtggtggtttatgcctgtaatcccagcactttgggaggccaaggcaggaggattgcttaagcctaggagttcaagactagcctggacaacatagtgagacctcatctctacaaataattttttaaaaatgagctgagtgtggtggtgcaggcctgtagtcccagctcttgggctaggcatgggggtcagctcaggtgggaggattgcttgagcccaggagttcaaggatacagtgaactatgattgtgccagtacactccagcctgggcaacagtgcaagaccctgtttcataaacaaattaaaaaaccccaaaaacctaggatgcaatgaagaaggaagccgaaacccaccaaaaccaagacggtgatgaaagtgacctctggtcatcctcactacccattatatgctaattataatgcattagcatgctaaaagataccaccagcaccatgacagtttacaaatgttgtattaatgacaggaagttaccctatatggtggaaaaaggaaggaaccttcagttctgggaatttcctccctgtttctgggaaaatcatgaataatgcacccttagtttagcatataatcaagaaataaccataagtatactcagttaagcagcgtggctgttctgcctatggagtagccacccttttttattcctttattttcttaataaatttgcttgaattccttcctgggtaaagccaagaacccatgtggcctcccatggtgatctccaattttgggattcaccatgtgacattaggagcaacttagggatctggtgcatcccaggccaagactaacatggtgatttttggggggttatgttaaaactgggggctctgcccaggcccctcagtgtggcttcttgagtcaatacctgggtacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttyctgcaagaaccccggctgggtgcccaggtctgagcctggtatgtgcctcagtatcacaaaggcctcctgtaaatgacayacattgttggaagtttcagaaattctaggtcaaaatggcactgaaatattaaggtatttaccccaacccaagcaacttttctaaaagttgtagagagtgtgacctctttattaattgaaacgtgaaaatcrgctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcrggcgtcttactgtttgaaccttgaattttaacctgggacatgtttgactaaaatgatgckgttmatrttttctgttgtgcaaaacacaaagagaactaggctycagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttwttaccagtactctgcatacacagtccaaragagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggktttttttttttttttttttttttttttgagacagggtctctcgctctattgcccaggttggagtgcagaggctgactgcaacctcaatcccctgggctccagtgatcctcccacctcagcctccagagtagctaggactacaggtgtacaccagcacacctggctaatttttttatttttttattttttgtggagaccaggtctcactacgttgcccaggctggtctcgaactcctgagctcaagcgatcctcccacttccacctcacaaagtgctgggattatagacatgagcctctgcgccccagcctcatctcattttaactaaaggaaacctttgcagtgattgtgaaccataaagaacccatatgtgcttgagcccrtgccatcttgggatattttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctcygatgtggaaatcagaaatgaagaaaacaacagcgrcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatwtwtttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaaygtttatgctttaaaaggtacttgtatcatctccttccttctttaaataagagtaacaggcaaaatcataaggtgcrtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataarcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttyttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcaraaracctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgcmgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttytatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggwggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtrcagagaaaggkttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcrgactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcagragagagatgtgcagtgagttgcttggatccctaccttttaatcagaatggtagattgctctcatctcttaaytggtggtggagttttkaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagrtacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttsacacatacaatctcctttaattaactctcacaatgactctgtgctatgtgtacaattatcacgttttacacacaaggaaactgaggcatggagcattgtaataatacccgagatcttctcactccatgaccartgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagrcatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtsaggctggtctcgaactcctgacctcaagtgattcacctaccttggcctcccaaagtgctgggattacaggtgtgagtcatcacacccagcctataactttttttwaataggtgatagaatcccgtgcttgaaaaataatcaaacaaaaagagaatgcattgtaagaagcctcactgtactcctgtccccagctgcccagttctcccctcctccccacrgggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaagstatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcargtatttctgggaggttctgggttactctagagtaggcgaggaatccctaggctccaccagctagctttatttttgtagagatggagtcttgccatgttgcycaggctggtctcctgggttcaagctatcttcccaccttggcctctcaaagtactgggattacaggtgtgagccactgcacctggcctccaccagcttrcttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccctcccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctccggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctcaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccacycccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggtyatatagaaatgaaggtcccaaggcagaaattcagttaygaatgctcttaaagkcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccrgatggacatgaatatatttatgtggacccgatgcagctgccttatgactcaagatgggagtttccaagagatggactagtgcttggtaagttccatggggtaacctyccaagactcccttttcccttgcacacaactttacaatttataggccttggcagaatagagatctgagcttgtgcttagtaagaactaggcaatggaaatttgctttcagaaatacatttctgtcttgacartaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagwtgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcaytgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttscctgggaactagactgcctttgcgggactaacgaattagctacaagattagaaagtatggtttaggggtcactgttgtaaaacctraggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcrcgctcacaccagggagggctgcaccctcctttctcccgtctgtgttttctttcccttgcaagtgttattcgacaaaagcaattatgctaatttccttccctgtgggctcaattccttttttgacasgatgacttggaggagtcattatgattactccaaacaggaaagacactcgcccagctgtccgcccgcagaragctggctacggtgcagaaagctgaggaggcgtctggagtttttgggtgttaatgattctgcctgcccacaggtcgggtcttggggtctggagcrtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatctgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaamaavcttttttggtatcttatttttttctgygccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatgrccacacggctcaagttccaaccaaggcttgtgagttgaaaaactgagaaagaataatgacagacttaaygtagtgaattcttcaaactttaagtgtaatggacttacaggtccatgggagcacagccccactgtcttagatgtggctcttcaggatgtgcgggctcctgctaargatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttwyatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctayctcagtacctggcacattgtaggtcccccagaatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggmagcccaygtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttwwwaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcaygagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcrtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatrtccagagcacactgatgcaaggggtggagctcttgggagggatggaacaccctgtggctttgcagggtttagcccctgcagctgctctcaggggctgttgtcgagtgcctgtggtttttcctggtgcagagtrcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatmctccgaaatctaggcagaggctcccaagcctcaactcttaacactctgtrcacccacaggctaacaccacatggaagcggccaaggtttatggctgtcacaagctgaagcagcagcccaagctgcacctgaactcctttgagccacrgctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagagagagagagagagagagagagagagaggtgccatacagttttaaacaggcagatcttgyaagaagtcactcacttttgcaaggatagcaccaaggggatggtgctaaaccatttgtgagaaattcacccccatgatccagtcacctcccaccaggccccacctccaatactggrgattacacttcaacatgagatttgggtggggacacatatccaaactatatcattgygygtgtgtgtgtgtgtgtataatttttaaaccagatatatgtttctgcatatctctttcctttctttcattctttctwtctttttttttttttttttttttgagacagagtctcactctgtcacccaggctgcagtgcagtggtgtgatctyggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggamggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggsagacagctccaagtgccaccatggatcagccagtcttgcaggggtgatgctatatcagctacagatggcttgatcctgagtcatttcttccttttccatgcagtgtgtccaccgtgatctggctgctcgcaacgtyctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtktgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttattwatttatttatttatttatttatttattttctttttttttgagacagagtctcactctgtcacccaggctggagtgcagtggygcaatcttggctcactgcaaacttctgcctcccaggttgaagcaattctcctgccttagcctcccgagtaggtgggattacaggcatgcaccaccatgttcagctaatttttgtatttttagtagagacagsgtttcaccatgttgcccagactggtctcgaactcctggcctcaagtgatctacctgcctcagcctcccaaagtgctgggatgacaggtgtgagccactgcatctggcaagtgttagctattaatatgtcaattrcgtgtatgcatggacaagcatgcattcccaaggatggtgtctttayattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagyttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccrcctcaaaccacatgttgtgccttattgtgtctgagataggcccatgcaggtggagatgggggtttttgttgggggttgcgtctyactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtaygtggcgggaagggcagggctctcattcctggttgtcattggccagtcttgacaacccaggtgctgaacaacccaggtgccctgggctatccggtgaggtccctaagagaaggatgagccataaccctgacatctggatggytcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatccccsagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaasgcyataggatctgaaaggttttctaacagygttctatcatgccaagtgtttcarcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtrcagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaatrggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggagrcagaaggaaattaaccctcagttggtcaaagatgctctgactggtggaaatgtgttggtgggaagagattgaagttattgttgaaaatagggtcttttcacatccaatgtkagacctctccaatgtttaaggatcatgaaggctttgggtattatccacccaatagaaggcctcactgcctctctrtgggacccatccaagccctggaaaggcaacgtgatggggaccagaaggattctcagttgtagctactgacttggagaaggggctactggtatcttagcacctaatggcagaagctctttaccattggtggcccyttcttcatgttctatgtctctggggatagttgacatgactctccttcaactaagtcccacatcttccaggtagtttggaratatgtacagttaaataatrgtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattkgaatcacctgcagagatttaaaaactgctgatctacaagcctcacccaaaacaacaaattagaatccctggkggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacakacctgcagccaacaagcatatgaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggwatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaacwacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgyctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttcttttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaagrtgctgggattataggcatgaaccacctcaccyggcctagattctttaactcagcaccaaggtggagctaatgcccaggcaggactgagaatcactggytgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacrttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtsagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgyaggagttgtaatatttgctcttctctccctcctccagctcgcagacctctgaagagagtgccattgagacgggttccagcagttccaccttcatcaagagagaggacgagaccattgaagacatcgacatgatggaygacatcggcatagactcttcagacctggtggaagacagcttcctgtaactggcggattcgaggggttccttccacttctggggccacctctggatcccgttcagaaaaccactttattgcaatgcrgaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccamggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaatyaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagtttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggmattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgkgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttatactaaggtttcagcatttttgtttttagtttaatcataagaattaaagcaatcctgttctatttactttcttagcaacatttgtaggactctatattaggccttttttttttttttcctgagayggagttttgctcttgtcatccaggctggagtgcagtggcgtgatctcagttcactgcaacttctgcctcccgagttcaagcaattctcctgcctcagcctcccaagtagctgggattataggcgcctgccaccatgcctggctaatttttgtatttttagtagagatgggggtttcatcatgttggccgggctggtctcgaactcctgaccttagatgatctgcctgcctcggcctcccaaagtgctgggattacaggtgtgaaccaccacgcctggcctttattaggcttttgatgaaccaatagaatatctaaggtttaagacattmtatgagctagattgttccacgacacagtatttgacttaaagatgattggcacttggctcatctttggtctcatcatttttttgattgttcatctttatcctgtggtgttttcttcccctgcataaggaatacaggactgcagtaactctgtacaacattcaactgtcgtaaaagtgtaggaagtaaaatgttaaattatttttttcacygtgtcttcttccctgtccctgtcctgtttccaagaggcagagctgcaccacttggtgtgtcttttaaacttccagttccctttgtatgcatctgtgtatatatattcccatacacacatctctacgtttgcttcatatctacctaaatgggttctcactttatgtaatcctttgtaatgttcttttttctttcctttttaaaactatttattaaagcagttttagatttgcagtaaaattgagtagaaggtacagagatttcccctgtgtgccctgcccccacaccaacatagcatctccatcactaacattctccacctttgctacagctgatgaacctacattgccaaatcattacccataacacagtccacagttctgttttttttttaatgctgttttagcgatctctgtgaaaagtatacagaggtattagctccattggatcccattatgtaaatgtaccataatttatgcaatcatggtcttgtaaaatggatttayagtttccagttctttgctattaaaatgatttcatgaacatttttgcaacatacatatttgcatacaaaaatgtgttttgtagaatggatttctacaaatgaaattgctaggccaaagggtgtgcaraaataaattgatgttgagctgaagtcttcagataggattgatacataagttcttgagcatctgcacgtgaatcactggctttgcacattacatgcagttttctagtctctgctccacattgcccaggaatcatggtcttcaaaataggattggaagaaatacaatgtggtaagtgtgagagaatgtgggttttgtgttctgaagcatactgaagcaagtgactttaggaatttaaaaaaatggtacaactcaccttattttgagctcacggataatgaaaattgattatgttgttaataatcagaatatagcaccctattccaatataactccttatccaaattcaagtagcctgcagctggaagcatacttctttggagttaaacctccaaggagggattcagaagatcatggcatatgagaggcaagactagattgcagctcaggacagagcagcatgcagcagcttgcattgtgaattttagctccagatcctgagaggacccacagaccctctgatggaagtggacttctcctgcaggaccggggagacaccccaaatattgtgagttgccccaaatgcggaagtggtacagggagaccctcctctaccgaatgcgcagtcccactggagcagctgaagttttgcttgcgggagaagtttctgactttacctcaagctgagtcaagttagagagctgagcaaaatacaggggtggaggaagcagcagaaaggccctgggagctcgctgagtccccaagcagcccattcctgcctggcaccacagggatccatagggagggtggccagaggagcagggggtaaaactccacagggagaaggaaatctctagctgaactttgtaacaatttgaaaggggcaagaagcttcctggccggaactcgggggagggtgcaaatcgggcgtacagacttcacaggcagaggaagaactaaagcccttttctctcccagctgggaggaggatagccttgggcaagttttcaagcccatcttgccctctgcctggaaacagactcagggctgttgaggtgggcagggtgggagtgagacaagcccttcggtttgtgggggagctgggtgaggcttgtgactgccggctttcccctacttgcctgacaacctgcatgactcagcggagacagccataatcctcctaggtgcacaactccagtgacctgggaatctcactcccatttccccccagcagcctcagcaagacttgcccaaggagagtctgagctcagacatgcctagcctcacccgcacctgatggtcctttcctatccacgctggtagcataagacaaaggacataatcttgggaattctagggctccgccctccactggttcctctccacactactatagctgatgcttcctgggaagtaccaccttctggcaggaggccaaccagcacaaagataaagcattaaaccaccaagactaaggaccctcatggagtccattgcactgtccaccacctccaccagaacaagcactggtatacatggctgagagacccatagatggttcacrtcacaggactctgtgcagacracccccagtaccagcccagagctgggtagactaattgggtggctagacccagaagagagaaaacaaccactgcagtttagctcataggaagccacatccataggaaaagggggagagtactacatcaaaggaacacccagtgggacaaaagaatctgaacaacagccttcagccctataccttccctctgacagagcctacccaaatgagaagaaaccagaaaaccaaccctggtaataggacaaaacaaggctcttcaacacctcccaaaatcacactagttcaccagcaatggatccaaaccaagaagaaatcctgatttacttgaaaaagaattcaagaagttagttattaagcttatcagggagggaccagaagaaggtgaagctcaatgcaaggaaatctaaaaaatgatataagaagtgaagagagaaatactcatggaaatagatagcttaaggaaaaaacaataaaaaattcaggaaactttggacacacttttagaaatgtgaaatgctctggaaagtctcagcaatagaattgaacaagtagaagaaagaactttagagctcaaagacaaggtcctcagattaacccaatccaacaaagacaaagaaagaagaataagatgcagccataaaaarggatgagttcatgtcctttgcagagacatggatgaagctggaaaccatcattctaagcaaactattacaaggacagaaaaccaaacaccacatgttctcactcataggtgggagctgaacaacaagaacacatgaacacaggcgggggggaacatcacacatcagagcctgtcagggggtgggggsccgggggagagatagcattaggagaaacacctaatgtaaatgacgagttgatgggtgcagcaaaccaacatggcacatgtatacctatgtaacaaacccgcacattgtgcacatgtaccccagaacttaaagcataataataaaaaaaagaaaaaagaataatatgaacaaagcctccaagaaatctggaattgtgttaaacaaccaaatataagaataattgttgttcctgaggaagaagacaattctaaaagcttagaaaacatacttgggggaataatggaggaaaacatccctggccttgtgagatactagacagccatatacaagaagcataaagaacacctgggaaattcactgcaaaaagatcttcacctaggcacattgtcatcagattatccaaagttaagaccaaggaaagaatcttaatagctgtgagacagaagcacaaaggaaaacctatcagattaatggcagatttctcagcagaaaccctacaagctagaagggattggggcactatcttcagcctcctcaaacaaaacattttatcggccaagaattttgtatccagcaaaactaagcatcatatatgaaggaaagatacagttgttttcagacaaataaatgctgagcgaattcaccattatcaaactaccactataagaactgctaaaaggaaccctaaattttgaaacaaatcctggaaacacattgaaacagaacgtctttaaagaataaatcacatagggcctgtaaaacaaaaatacaatttaaaaagcaaaaacaacaaacaaaaaaccaaaccacagaggcaacaaagagcatgatggaagcaacagtacatcacatttcaatactaacattgaatgtaaatggcctaaatgctctacttaaaagatacagaaccacagagtgggtaagaattcaccaactaactatctactgccttcaagagactcacctaacacataaggacttacacagaattaaagtaaaagaatggaaaggggcattttgtgcaaatggacaccaaaatcgagcaggggtaactattcttatatyrgaaaaaaacaaacaaacactttaaagcaacagcagttaaaagagacaaagagggacattatataatggtaaaaggccttgtccaacaggaaaatatcacaatcttaaacatatatgcacctaacactggagatcacaaacttataaaacaattactaatagtcctaagaaatgagatagacagcaacgcaataatagtgggggacttcaatactccactgacagcactagacaggtcatcaagacggaaagtcaacaaagaagcaatggatttaaactatactttggaacaaatggacctaacagatatatacaaaacatttcatccaacaacctcagaatacacattttattcaacagcatatggaactttctccaagatagaccatatgataggccataaaataagcctcaataaatttaagaaaattgaaattatatcaagtactctctcagaccacagtgaaataaaactggaaatcaactctaaaaggaatcttcaaaaccattcaaatacatggaaattaaataacctgctcctgaacgagcattgggtcaaaaacaaaatcaagatggaagtttaaaaattctttgaactgaatgccaataacgacacaaccaatcaaaacctctgggatacaacaaaggcagtgctaagagtaaagttcatagccataaatgcctacatcaaaaagcttgaaaaagcacagacaacctaaagtcacatctcaaggaactagagaaacaagaacaaacaaaacctaaacccagtacaagaagaaaataaccaagagcagaactaaataaaattataaccaaaaaaaagataaatgaaacaraaagctgatcctttgagaacataaataaaatagaccattagcaagattaaccaagaaaagaaragagaaaatccaaataacctcactaaaaaacaaaacaggagatattacaactgacaccactgaaatacaaaagatcatttaaggctactatgaacacctttatgtacataaactagaaaacctagaagagatggataaattcctggaaaaatacaatcctcgtggcctaaatcaggaagaattagatatgctgaacagaccaataacaagtagtgagattgaaatagtaattaagaaattataaaccaaaaaaagtccaggaccagatggattcacagcagaattctaccagacattcaaagaagatttggtatcaatccttttgacac

SEQ ID NO: 13296 - DNA, 35770 bp, Homo sapiens
  misc_feature (1)...(35770): n = A,T,C or G, or insertion/deletion polymorphism (see Tables 1-2)
gaggccagagggtgatgagggagggggagagtgatgggagatgaactcagggaggggagcaagagccaggccacgtgggccatggtggagggtctgtaaactggggggtgaggaggggattaagagtcctagagggtggattaaatgaatggatgcttaaagtacttagcatagcatctgggatttagttagtactyggtgcattttctttttttcttttctttttttttttagatggaatttcgctcttgttgcccaggctggagtgcaatgggaccatcttggctcactgcaacctccgcctcctgggttcaagtgattctcctgcctcagcctcctgagtagctgggactatgggcgtgcgccaccacacccagctaatttttgtatttttttagtagagatagggtttcagaatgttggccaggatggtctcgatctcttgaccttgtgatctgcctgccttagtctcccaaagtgctgggattacagacgtggctaattttgtgggtgtgtgtgtgtgtgtttttagtagagacagagtttyaccattttggccaggctggtctcgaacccctgacctcaagtgatccacctgccttggcttcccaaagtgctaggattacagatgtgagccactgcgcccatcctaatttttgtatttttagtagagatgggatttcgccatgttggccgggctggtctcaaactcctgacctcaggtgatcagcccgcctcagcctcccaaagtgctgagattacaggcgtgagtcactgcgcctggcttgtttgttcattttttgagatggagtctcactgtgtcacaccagctggagtgcagtggtgcaatctcggctcactgcagcttytccagcgattctcgtgcctcagcctcccgagtacctgggattacaggcacctgccaccactccagactaatttttgtatttttagtagagacgaggttttgccatgttggccaggctggtcttgaactcctgaccttagatgatccacccccccctaagcctcctaaagtgctgggattagaggtgtgagccactgcgctcagccttaatttttatattatttgtagagatggggttttgccatgttggtcaggctggtcttgaactcctggactcaagggatctacctgccttggcctcccaaagtgctgagattacaggtgtgagccactgtatcctaccactcagtgcattttagctatcattatcacccctcagtaggatcgaaattgttatgtgtgtttcaggatgcgctcctggagggtacccttggccccatcttaatccttggactaggcttgwaaatatggggtgagaatcgtaataaaatgatattgaagacttatcccgtgctcactatgctcattacccattcatggattaatgggttaatggattagtgggttatcatgggagaggaagtggtggctttataaaatgagagagagagacgtgagtggcatgttagcacactagccttgggactctctgaagagttccagcaagaaggctcttactagatggggctcctccaccttggtcagtctcctataactgtgagatagaaattccttttctttataaattatccagttttggatattatgttaagagtaacagaaaacaaatgaagacaatgaggaatgcattattactcagctcattttatagatggggagaccaaggcagagaaagctaacttgcccaaggttgcagaggcaggaagaggtagtgccaggatttgaacccagatacttggttccagagtccatgcttcgtaacccctaccagtagatgccacagagaaacagtcctayagccacagcggcatccccttcccratggctgcctcccacccctctatgtcccggctctcactgcaggggcggcatggaagctcctgtcaggcgtgcgggagggccaaacgcaagtggacaccccgcagataggggacatggcttactggtcccaccccatcgacctgcacttygccaccaaaggtcttcaaggtgggtatcacacctggacccgggkccaggctgaggggagggggccagtagcctctgaggtccctggggctgggaacaccaagacctgtccctgctccccataccacgtaggtcccttttgcagccaagtctggccctggagaggctgagctaaggccttcccaggcctgctcaataggcgatcccaagtttgtatgattagggcagaggccagggtggagcaggaggtgggaaggtggggggtcagggtgggaggggaggtggcattcaagtaaagagacaaaacgagagtctccaataaagaggaagccgggaggcagggtctgagagaggcaagggctgtttctccaggaagggctcctcggcttgaaagtagagctgctgctcaaaggggaaatcagtactgggggaggagcggcatcagaaagcctttctagtagaaaatgtgggttcctggagatgagttgattctgagaaattgcctaggtaaatgtgccatatatttcaccaatataaagaacgtctacctggtacctgccctgtgtccagcctgtgttgggtgatgccagggagacattgaggatcaaggcagtgtcccttagccttgtcctcacagggttcaccgtcctatggggggacacacctctctccagacagtggcacctcagagtgggcaggactaagataggtgatttggagaggctgtgggagcccagaggaagtggctgactctgtcagggaggtcagagagggcttcctggaggagggggcttctgaactttgctgtgaagggccagcggagctaataaggcagagggatagaagaaggttctaggcagagggagctacgtggaagactcaaaggggaaagtgagccaagggcatctagtggattgagggagagcgggacggcagaggggaaaggcagaaggggacaggccatgcagggccttgagtgccaggctgaggagctgaggccatctcctgaaggcacttgggagccagagcaggtaatggacaagtgagatttcaccttttttttttggagacagagtttcactctgttgcccaggctggagtgtagtggcaagatctcagctcactgcaacctctgcctcccaggttcaagcaattctcctgcctcagcctcacgagtagctgggactacagccacgtgccaccacatctggctaatttttgccttttttttttttaatagagatggcgtttcaccaaggtggtcaggctggtctcgaactcctgacctcaggtgatccacctgcctcggcctcccaaagtgctgggattacaggcatgagccaccgcgcctggctgagrtttcacttttaaataatctttctgtcttttaagctggagctggggaaaaaaaaaatctttccggtgctgtgtgggtgaggtgggcagctctaacctttcagctcttggggcctccagtcccccagtggtggcaccagccttgctttctcttttctcaagcccccattttgtccatcaggaaatcttaaactgcctctacttttgaaatayatcctaaatcccacttcttacccttttctcgcccagcaccttgatctgtccaagttcttctctcacatggactatgacaagaatcttgtctctggagtccccttccccaacccccctggtctgcaccccacatgcagctgggaccctgtgaacacctaagtcaggtcccatctctgctctgctcagaaccctccaatggtccccatctcactcagggtgaaagccatagtcttagcatgcatcacaaggctctccacaaccaggctggcacctccttcccgtctccccacctcattctgctctagccatgctgtccccaccaggcacactccgtctgggctccagccatactgtccccaccagacagtccccccccagggccttggcacttgctrttccctctggctaggagcactcttcctctagatggccacatggcctactcccttccttccttttagcatttgctcaaatgtcaccttcttaatgaagcttccttgatccycttcttgctaaagcggtatccccaccctcaccctacccagctctgttttccctcacagcaattaccaccatctratctaccctataatttgcttatttactacattcgttgtctaggatatcagcttcacgggggcaggaatttttgtctgccatccatgttcatgtctgccgtgtccccagctagctagaacagagtctagcacaggagaagggatcagcatgagatgagatggggctggatctccaagggctttgactaccagactgaggagctgaactgtgttctgaggacatgggcaaagctatggaaggagagaaagatgcttccagatgccaggtggaaggtggattagagaggggcaagaaagaaggccctgggcccaaagrgagcagggcagggacatgaggagggaaggcaggaggtgtccctgacaaggcccatgatggttacctggggactggaggagcaatgggctgccctgacatggggtcatggaggaggataacacagagaggaaattcagcagaggtctgattagaagggccttgaatgttgaagaggttggactttatactgagggcactggggagctatggaaggatccttagcaggggagtaacatggatttggaaagatcactttggctgctgtgtggggatagataagacggtgggagcctagaaaggaggctgggttggaaactctgggacagaaacccagagaggaaaagactgggcctggggtctccagtgagtatcagggagtggggaatcagcaggagtctggtccccacccatccctcctttcccctctstctcctttcctgcaggctggccccggctccatttccaggtgtggtcccaggacagctttggccgctgccagcttgcaggctatggattttgccatgtgcccagtagcccgggcacccaccagctggcctgccccacgtggcggcccctgggcagttggmgagaacagttggcacrggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactytagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatcyytcaggtgtcctgttgccccctcctcccactgacaccctccggaggcccccatgttgacaraccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccmtgggccatctccctcccacctccywccgcsgagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcytcccgcaaagacttttccccagacctcgggcgcaccccctgcacgccgccttcatccccggcctgtctcctgagcccccgcgcatcctagaccctttctcctccaggagamggatctctctccgacctgccacagatmccctattcaagaccacccaccttctggtaccagatcgcgcccatctaggttatttccgtgggatactgagacacccccggtccaagcctcccctccaccactgcgcycttctccctgaggacctcagctttccctcgaggccctcctaccttttgccgggagacccccagcccctgcaggggcggggcctccccaccacaccagccctgttcgcgctctcggcagtgccgggggrcgccgcctcccccatgccgccctccgggctgcggctgctgcygctgctgctaccgctgctgtggctactggtgctgacgcctggcssgccggccgcgggactatccacctgcaagactatcgacatggagctggtgaagcggaagcgcatcgrggccatccgcggccagatcctgtccaagctgcggctcgccagccccccgagccagggggaggtgccgcccggcccgctgcccgaggccgtgctcgccctgyacaacagcacccgcgaccgggtggccggggagagtgcagaaccggagcccgagcctgaggccgactactacgccaaggaggtcacccgcgtgctaatggtggaaacccacaacggtgarctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagmratagggggagggtagaaggctccctcttccmggacgcgttgaatggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagmccagcggaggaatcgagcttccagaagacctagagtcctgggtcatgggaagggctttaccgagaggggagacaggcgtgggaaaggtggtgtgagcggggaggaggagagatacccagcgccatccacgctgcgagcagcgagcccccccattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatccycctcccttccctttccttcccatgcccccggcggrggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtcckgttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcaccmaggctggagtgcagtggcgcaatctcggcacactataacctctgcctctcaggttcaagcgattctcatgcctcaacctcccaagtagctgggattagagccgtccggcaccatgcctggcyaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcrcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgyggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcrggtggatcacgaggtcaggagatcgagaccatcctggccaacatggtgaaaccccatctctactaaaaatacaaaaattagctgggcatggtggcatghgcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaawaaattcatttaaataaataaataaataaataaataaataaataaataaataaaaggtatcagagactgactccaccccagagctgtcagctccaaaactcctagagttgggagcaccagctcccctcacctctgccaaacccctgatckcctcccttcatttctccctgctagaaatctatgacaagttcaagcagagtacacacagcatatatatgttcttcaacacatcagagctccgagaagcggtacctgaacccgtgttgctctcccgggcagagctgygtctgctgaggctcaagttaaaagtggagcagcacgtggagctgtaccaggtgaggacatgagccagaaggaaggtcagggcatgggctggagagggtgagctgtgaccaagggggtggctgtgggtcggctggttacaaggtccacctagatggtccctgaargatagaagaacacaaaccatacaatcctagaackcttttttttttttttgagacagtgtctcactctgttgccaagctggagtgcagtggtatgacctcagctcactgcaatctccgcctcctgggttccagtgattctcctgcctcagcctcccaagtagctgggattacaggtgtgcgccaccacgcccagctaatttttgtatttttggtagagatggggttttaccatgttggccaggatggtctcgatctcctgacctcgtgatccacctgcctcggtctcccaaagtgctcagattacaggcgtgagccactgcgcctggcctcttttttttttttttttttttgagatggagtcttgctctgtcgcccaggctggagtacaatggggtgatctcggctcactgcaacctccgcctcctgggttcaagtgattctcctgcctcagccacccgagtagctgggattacaggcatgtgccaacacgctgggctaatttttgtatttttagtagagacagagttttatcatgttggccaggcttgtctcaaactcctgccctcaagtgattctcctacctgagcctcccagagtgctgggattacaggtgtgagccactgcacccggaacctagagcacttttaaatgttcagactctttgcatcctaggatgttaaacacttagaaggctggaatcttaggagttggactctttaaggacacaggattcttgaaagttggaatctctgaaaaggttgggggctctagaatcattctgtccaatatgacagccactagtcacatttagcttgattaaaatttaaattgtttaaaattaaattaaaaatttagggccaggcatagtggctcacacctctaatcccagaactttgggaagccgaggcaggcagattgcttgagcccaggagtccgagaccagtctgggcaacatgttgaaacttcgtctctacaaaaaatactaaaattagcctgttatggtgatgcgtgcctctagtcccagctactcagtagtctgaggtgggaggattgattgagcccaggaggtcgaggctgtagtgaactgtgattgcaccactgcaytccagcctgggtgatggagcgagaccgtctcaaaaatatatatatataggccaggcgtggtggctcatgcctgcaatcccagcactttgggaggccagggtgggtggatcacttgaggtcaggagttcaagaccagcctggccaacatgacgaaactccatctctactaaaaatacaaaaattagccaggtgtggtggcaggcrcctgtaatcccagctacttgggaggctgaggtgggagaatcgcttgaccccaggaggtggagactgcagtgagcggagatcataccactgcactccagcctgggcaacagagcgagactctgtctcaaaaaaataaaaatgaaaaagaaatcctcattctcactggccatatttctagtactctatagtcacatgtggttagcagctactattttggatgttgcagataaagcacatttccagaaagttctttaggacagcactgctctagaagatagggagcttccaagaggactggggcatctggaagggctggaggctctagcagtttctatgagctagaatccatatcagagggaatgttaactcataggatggtagatttcagactttcacagtgagagaactttgtcctatgttagcttggcttcttggagtctggggaattcagctttattctgcagtccctggagtggactatccagccccagaaaattcttcttttttttgtgtgtktgtgtgatggagttttgctcctgttgcccaggctggagtgcaatggcaccatcttggctcaccacaacctttgcttcctgggttcaagcgattctcctgcctcagccacccgagcagctgggattacaggcatgcaccaccacncctagctaattttgtatttttagtagagacggtgtttctccatattggtcaggctggtctcgaacttctgacctctggtgatccaccctcctcggcctcccaaagtgctgggattacaagcgtgagcgactgtgcctggcccagaaaattattctacacagatgttgggtacctgcagcatctaggtgcggcatggcagactcttgggtttatagaacattagtcttctaaagcttctcaggctctagaagtggaaatcttgggatattatcaaacatttgaatcacaaaatgactttttttttttttgagacagagtctcactctgtcaccctggctagagtgcagtggtgcaatctcggctcactgcaacctctgtgtcttgggttcaagtgattcycctgcctcagcctcctgagtagctgggattacaggcgtgtgccaccacgcctggctaatttttgtatttttagtagagacgaggtttcactttgttggccaggctggtcttgaactcctgacctcaggagatccacccgccttggcctcccaaagtgctgggataacaggcgtgagccaccgtgcccagccggaatcattagaaatkacttctaagttactgagaattcagggtgtcaaatttgcagaaccgtatgctcagtaaaccccagaatgtttgcagcagaattttattttatttattattattattttgagacgaagtctcgtcctgtcgcccaggctggagtgcagtggcgtgatcttggctcactgcagtctgtgtctcccgggctcaagcarttctcctgcctcagcctcccaaatagtggcgactacaggcgtgtgccaccatgcctggctaatttttgtatttttagtagagatggggtttcactatgttggccaggctggtcttgaactcctgacctsaagtgatccacccaccttgggctcccaaagtgctgggattacaggcgtgagccactgcrcccggcccagaatgttagcagcagaattttagcattgtgggctgtccacgctgagtggggcttagcatttcaccaatgaggaaayaggcctcgagaaggcaagaaaacaccttcggctgagctgtgtgaaggtgacttgaccrcagcctgagctttttctccacccctcctctcatgggtactgttggggaggatgggtgccacaggaccacacaggtggctgtctgagagggtagtgcctgggaactttctggaagcctgtttggggaagcagatggggtgaaggattcagttagtgtatgtggggtcgtgacaccatctacccactgtctctctcctgccttcatcatcctctagaaatacagcaacaattcctggcgatacctcagcaaccggctgctggcacccagcgactcgccagagtggttatcttttgatgtcaccggagttgtgcggcagtggttgagccgtggaggtgaggattacttgtgtgtcccacccctgtttctccctggggtccaccccattgtttgtcctggggtcactttgcctaggacccctctccgccccatactggtgtgaaagtgctgagacctggctcccctctgtggcatggaaacctgagtgattggctaatctgtttcctgagcacctctctgccctgccctgtgatgggtgatgccaaggacacagcaatgaccaaaacagccccatccttgccctcacagagctcatatagtccattggctaggtagctggggaacagacctgtaaggcagtgatgacccagagtgggtgggactgggatggggagcccaaaggaggtacctgacccagcccagaatcagggagggcttcctggaggaggggcaccatagctgatgttgaagggatgagtagaatggtcaggaaaaggagaggtgtaagagtattctggggctgggcatggtggcttatgcctataatcccagcacttttgaaggccaaggaggatggatcactggagctcaggagtttgagagcagcctgggcaacatggcgaaacccggtctctacacaaaaatacaaaaattagccatgcatgctgttacgtgcctgtagttccagctgcttgggagactgaggtgggagaatcacctgagcctgggaggtcgaggctgcagtgagycataatcacastactgcaatccagcctacatgaaagagtgagatcccatctcaaaaaaaaaaaaaaaaaaaaaagattccaggcaaagggaacagcctgtgcaaaggcctggaggccagggagagcctaachcatttgatctgtccaggagatgattgtctctgtctggtttctggcagggcccatggtgcccctatctctctccctcacctccctctcatttatgcttttattcaataattgcccacaggttcctgctgtrtgcctggccatgtgctgggtggtgtgggggacatagtgataaccaagacagccctcagttctgccctcatggggcccacagtcacttctggacacctaagagatcttgtcaaggccccaccaggcaggaatgacctagaatgatcaagaatgggatggggaggcaccagcagggaggacaaggctgggacagggaggcmtgcaggatgggggaacgccctaagtgctgttgggagcccagagaaggcacctggacccatctggggagtctaggagggcttgctgggtgagggtgattgtgtggagactcacaggataaatagtagtttggccacatgaaaaaaaagggattagggggcctggcatggtggctcacgcctgtaatcccagcactttgagaggccgaggtgggtggatcacctgagatcgggagttcgagaccagcctgaccaacatggagaaaccccgtctctactaaaaatacataattagctsggcgtggtgatgcatgcctgtaatcccagctactcgggaggctgaggcaggagaattgcttgaacccaggaggtggaggtttcagtgagccaagatcgtgccattgcactccagcctgggcaacaacagtgaaactccgtctcaaaaaaaaaaaaagaaaagaaaaagaaaaaatagggattagggagcaggtgggcactgggaggagtgtcmtgggctgttcgacaaaggcctagaaggagctcatctgtcttggtcaatgmtgagtcccaagcacacagcacaggcttcggcacattgtaggagcctagaaaacatcattcactcattcattcaagagattgatgctggcygggtgcagtggctcatgcctgtaatcccagcacttcrggaggccagggcaggaggattgcttgagcccagcctgggcaacatagtgagacctctgtctctacagagaatttaaaaagtagccgtgtaggccggatgcagtggctcaagcctgtaatcccagcactttgggatgccaaggcaggcggatcacctgaggtcaggagtttgagaccagcctggccagcatggtgaaaccccatctctactaaaaatacaaaaaattagccgggtgtggtggcgcatgcctgttatcccagctacttgggaggctgaggcaggagaatcgtttgaacctgggaggtggaggttgcagtgagctgatatcacgccactgaactccagcctgggcaacagagccagactccatctcaaaaaaaaaaaaaattagccatgcgtggtagcacgcgcctgtggtcccagctactcgggaggctgagatgggaggattgcttgggcctkggagattgaggctgcgagaccttgtctcaaaaaaaaaaaaaaaaaaaaagagagagctgcagtgagagggcagagtggggtgggtgggggaggcaggaaggaagcccctggggtttgctccttccttcctcttcctccaggggctgggtgagctgcactctcagactggcttccctctcgccactcctacaggggaaattgagggctttyrccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctractcccacaccaaagcagggttcactacmggccgccgaggtgacctggccaccattcatggcatgaaccggcctttcctgcttctcatggccaycccgctggagagggcccagcatctgcaaagctcccggcaccgccgagccctggacaccaactattgcttcaggtgagccttgtagcctggatggaggccttccaggctgggggcatgactgcyatctgctgaccaggtgctccaggttggacacctggctgctgctgtgcttgggctgagcatctgtctcctttagcttggagggctcaggggatgaggtctgggtgtaagaaccaggagtcttgtgccaggtgcggtggctcacgcctgtaatcccaacactttgggaggctgaggcaggtggatcacctgaagtgaggagtttgagacctgtctggccaacatggtgaaacccgtctctactaaaaatccaaaaattagccaggcgtggtgggcgcctataatcccagccacaaaaaacaaaaaaagaactgggagtcttgtaatgttgggatcaggttcctttttttttttttttttttttttttgagacagagtctcgctctgtcacctgggctggagtgcagtggcgctatcttgattcactgcaagctccacctcccgggttcacacgattctcctgtctcagcctcccgagtagctaggactacaggcacgtgccaccacgcccagctaatttttttgtatttttagtagagatggggtttcactgtgttagccaggatggtctccatctcctgacctcgtgatacacccacctcagcctcccaaagtgctgggattacaggcgtgagccaacgcgcccggcctaattttttgtatctttagtagagactgggtttcaccatgttagccaggatggtcttgatctcctgacctcgtgatccgcctgcctcagcctcccgaagtgctgggattacaggtgtgagccaccacgcccagccttgctttcttgctggagtgttggaatcacagaatgttagaaagttgaaccctgtgattgttggaattcaaagttggaaggtcaccatcttgaatccctaaattgttggcaggttgaggttctagaatgctgggattctagaatgctagaatttggtgttaattactgaaatggaaaatgtcggactcaaggaaagctgaaacattggaatcctagaatttggggattcaaaatgggaagatggcccatgtggaattcctgcaccactggccaattgtggataccagtgttggcagattggagtccttgaatattgggctcacagtggtagaattctgttttgaaatattcacatccacaaatgttggagttggagaaagcmgaatattggtatctcagcatgttggaactcagtgttggaatgttagaatattagaatgctgggattttattaatagaaagtggcagcaggctgggcgcggtggctcacgcctataattccagcactttgggaggctgaggtgggcggatccctgasgtctggagttcaagaccagcctggccaacatggtgaaaccccatctctattaaaaatacaaaaattagccaggtgtggtggctggcacctgtaatcccagctactcggctgggattacggctatccaggtacccaggctggggcaggagaatcactggaacctcgggggkggaggttgcagtgaaccgagatcgcgccactgcactccggsctgggcaatgatgcgagactccatctaaaaaaaaaaaaaaaaaaaaagaaagaaagtgtcagtttgaacctcttgagtgatggctcagaactttggaatgttgggatgcaatactggcatactggaattcaggaatgccaagatcctcaaaggttggaaagggggaatcctagagagttgaagatgctgtcagaatgttagaatcataagatgctggaatgctaatactgcaatctaagaaagctgaaatgttggattcctagaaagttgaaatggagagttagaatgttgtaaatttagagtgatcatctgaccttattcctcccttgctyaaaatattttggtcctgtctctgggctttgttaccggctgtttccctgccagaaaatcagccctgctcccrggctccttcaccaccagatcttagcgccatcagcccagcaacsctgtcaatgaacaaattgaggtcttttttgagacagagtctcgctctgttgcccaggctggagtgcagtggcgtgatctcggctcactgcaacctccgcctcccaggttcaagtgattctcctgcctcagcctcctgagtagctgggattacaggcgtgtgccaccacacccggctaatttttggtttttttagtagacactgggtttcaccatgttggtcaggctggtctcgaactcctgacctcgtgatccacccgcctcggcctcccaaagtgctgggattacaggcatgaaccactgcrcccggccacaaattgaggtcttgagtgccaacagctcctgacattacaaagggagatagccagccatgtcagcctccgtagggagggacccaatgttgcctaggaagtcttggcaaaaaatcaaacctgaaggccaggtgcrgtggctcatgcctgtaatcccagcactttgggaggccaaggcaggcagatcgcttgagcttaggagttcaagaccagcttgtgcaacatgttaaaaccctgcctctgtacaagaaatacaaaaaaactagctggctgggtggtgtgtgcctgtagtcccagctacttgggaggctgaggcaggagtgcttgagcctaggaggttgtggctgcagtcagccaggatcacgccactgcatttcaggacagagcaggaccttgtctcaggaaaaaaaaaaaaaaatcaaacctgaatctgatcaggactgtagatcctaacagttttctagaaagacaggaacagaggaaatggtcagcaaaactcagactgcaagaaacctcacccagtttcttcatcaaatacaatgcaaagaaggggaaagcacacacacacacacacacacacgtaccccccatgcaaccaaaaattcacatacaagttttgactccccaaaaacttaactattaatagcctactgtggactggaattctgctttatccacaacataaacagttgattaatacttttttttttttttggagacagagtctctgtcattcaggctggagtgcagtggtgcggtctcggctcactgcagcttctgcctcccgggttcaagtgattctcttgcttcagcctcccgagtagctgggaccacaggtgcccaccgccacgcccagctaattttttgtattttagtagagatggggtttcaccgtrttgcccaggctggtcttgaactcctgaggtcaggcaatccgcccacctcagcctcccaaagtgctaggattacaggcatgagccactgctcccggccgaataatacatattttgcatgttttatgtattatgtcctatatcccctttttttttttttgagacggagtttcgctgttgtcactcaggctggagtgtaatggcacaatctcagctcacggcaacctccacctcccgggggttcaagcaattctcctgcttcagcctcctgagtagttgggattataggcacctgccaccatgcccggctaacttttgtatttttagtagaggtggggtttcaccatgttggccaggctggtcttgaactcctgacctcaagtgatctacccgcctcagcctcccaaagtgctgggattgcaggggtgagccacgcacccggccgtattctttgtttttttttttgagacagagtctagctgtgtcacccaggctggagtgcagtgaagtgatctcagctcactgcaacctccgcctcccaggttcaagcaattctcctgcctcagtctcccaaatagctgtgatttcaggcatccgccatcgcacccgggtaatttttgtatttttagtagagacggggtttcaccatgttggccaggctggtcttgaactcctgacctcaggtgatccatcagcctcggcctcccaaagtgctggccttacaggcttgaaccactgctcccggcctatgcctgcattttaaaaataagatagagaaaagaaaatgtccttaagaaaatcataaggaagaggaagtatattttccattcattgagtggaagtggcttatcataaaggtcttcatgttgagtaggctgaggaggaggaagaaaaggtgttggtcttgctgtctcagggcagaggtggaagaaaaattcacctgtaagtggtgaattttgtaagaggacccatgtagttcaaacccatgtccaagggtcagtctatatatagttgaccctgaatatatatacagagagagagagagatgattttgtagattttgaaaaaagtcctaagagaggccaggtatggtagctcacrcccgtaatcccagcactttgggaggctgaggcaggtggatcacttgaggtcaggagttggagaccagcctggccaacatggtgaaaccctgtctgtactaaaaatacaaaaatcaggccagctgtcgtggctcacacctgtaatcccagcactttgggaggccaaggtgggtggaccacctgaggtcaggagttcgagaccagtctggccaacgtggtgaaacctcctctctactaaaaattcaaaaatgagccaggcgtggtggcgggccctgtaatcccagctactcttgaggctgaggcaggagaactgcttgaacccaggaagtggaggttgcagtgagccgaggtcgcgccattgcactccagcctgggcaacaagagtgagactcccgtctcaaaaaaataaataaataattaaaaatacaaaaattagcagggtatggtggcaggcgcctgtagtcttagctacttgggagactgaggcaggagaatcacttgaacctgggaggcacaggttgcagtgacccgagattgcaccacttcactgcatcctgggtgacagagtgagactccatctcaaaaattaaaaaaaaaaaaaaatcctaagagacatatcaaccaattgcaatgtgtagaccttacttgaatccttatttacacaggcttaaaaaaaaaagatatttatgagacagttgggtaaatgtgaactctgtctagatattcctctagatatcaaggaattgttaattttcttacatggtattgtgactgtgttttaaagtagtcttaattagagatacatttgaaatatttatggatgaagcaacacggtggattgcatgtgctttgagataaaccattgtcggctggctgcagtggctcacagctataatcccaccactttgggaggccaaggcaggaggattgcttgagcctaagagttggagaccagcctgggcaatatggtgmaaccccatctcccaaaaaaaaaaatatgaaaagtagctgggcctggtggtgtgtaccttttgtcccagctactcaggaggctgaggtgggaggttggcttgagccccaggagctggaggccacagtgagctgtgattgcaccactgcactccagcctgggtgacagagtgagatcctgtctcaaaaaaaaaaaaaaaagagatagtggataggggtagagatgcaatggaaattggccatgagttggtcattgttgaagctgcttttgtgtacatctgaaactttccagctggacgcggtggctcacacctgtaatcccagcactttggaaggctgaggcgggtggatcacatgaggtcaggagttcgagaccagcctgtccaacatggtgaaaccctgtctctactaaaaatacagaaaaattagctgggtatggtggtgtgtgcctgtaatcccagctacttgggaggctgagccaggagaattgcttgaacttgggacatggaggttgcagtgagccaagattgcaccactgcactccagcctggggcaacagagcaagactccatctcaaaaaaaaaaaaaaaaaactttcataggaaaatttgttcttaaggcagctcgaacactacctccttcctaacccctttctccaacatccaagatggatgtgaggcctctgggcctcccctggggccctaagtagatctttgactcaacaaacagtctctgttgggtcttttatttataaaaagttttgtagcgacagggtctcactatgctccccaggctggtcttaaactccttgggctcaagcgattcaccggtcttggcttcccaaagtgctgagattacaggcgtgagtcactgcacctggcctaggtcttgagagactggacggaagaggcttggcaagggcaagggctgtgggtatcccaaggcccggtgcagggtaggccccgaatgtgtgctgaaaaaatgagtcagaggatcacctagacggcttgttcaacacggactgttgttcccagtcctgcacacaatttctgatttcagtggcctggggtgccacctgagaatctgcatttcccatagttcccaggtgatgctgccgctggtcctgggagctcacgtggagagctgctgacttggataacagtatcacagattgttcaaatcctaggatctcagaaccccagctagggttgaactgcatattaaagatgattctgagccgggtgcggtggctcatgcctgtaatcccagcactttgggaggccgaggtgggtgggtcacctgaggtcaggagtttgagaccagcctgaccaacatggtgaaacccagcctctactaaaaatacaaaaaattagccaggcatggtggcacatgcctrtaatcccaggtacttgagaggctgaggcaggagaattgcttgaacccgggagacggaggttgcagtgagctgagatcacaccaycgcactccagcctgggcaacaggagggaaactccatctcaaaaaaaaaaaaagattccggacactagttcttccccttttgtgagttcagaacttcctgtgagaaagtgaaagccaggactctttttcccagaaatacatgcatacatacacacatgtgcatatgatctcaggcactcatggccctccctaagcctgcccatgatggccccttggccctcagcttaacaccttattttatctagtagctcctacctctgaacagatgaggaaactgaggtccaaccaaattgggtggtacgggctgagttcacagggatctcagtttcttgacttccttctcaggcttctgtggctcttggaaaggctttatcttgcctctaggttatccggtgccacttgaagttgggttcaagcgattctcctgcctcagactccccagtagstgggattacaggtgcccgccaccaggtccagctaatttttgaatttttagtraagacagggtcctcaagtctgcctgccctagcctcccaaagtgccgggatgacaggcgtgagccaccgtgcctggctggccccaccaatctatgagcagaggttgcagtgagccaagattgcaccactgcactccagcctgggtgacggagcaagactctgtctcaaaaaaaaaaaaaaaaaaaaaaggcattgtcaactttttcttttcttttctttcttttttcttttcttttcaagacagagtctcaccctgttgccctgggtggagtgcagtggcacgatcttggctcactgcaacctctgcttcttgggttcaagcagattcttgtgcctcagcctcctgagtagctgggattacagacaagcaccgccacacccagctaatttttgtatttttagtagagacggggtttcgccatgttggtcaggctggtctcaatctcctgatctcaggtgatccacccgccttggcctcccaaagtgctgggattacaggcgtgagccactgcacccggcctctttgacagttctaagaagtaaaataaaccagaagaaggcaggcagagagtaatagatattgggaactgttatttttcctattctgatttaaattcctttattatggaaaatttcaaatgtatacaaaagcaatgaagataatgaatgccyrtaaactmtcatccagcgtcatcggtaattaagattttgccccatttcaaatgcagacatttttatattttcttgcataactgcaataccgtattgcactaaatggaactaacagtcacttggatattttggaaaggatggctcagaaaggtatctctgaggaggtgatgttcagtcatgtaactgatatttactagtacctactgcattccagrcactgctttaggagttaagggtccctgagtgaaggacatttgagctaaggtttaaatgaagtgaaggggccaggtgtggtggctcatgccagtaatcccaatgctttgggaggccgaggcgtgcggatcgtttgagcccaagttcgacaccagcctcagcaacatagtgagaccgtgtctctaaaaagaataacaaattaaaaagaataaataggccagatgcagtggctcaggtctgtaataccagcactttgggaggctgaggtgggcggatcacaaggtcaggagttcgagaccagcctggccaacatggtgaaaccctgtctctactaaaaagacaaaaaaattagccgggcatggtggcacacgcctgtaatcccagctactcggaaggctgaggcaggagaatcgcttgaacctgggaggcggaggttgcagtgagccgagatcatgccactgcactccagcctggcagacagagtgagactststctcaaaaaaaaaaaaaaaaaaaaaatagaaaaaaaaagaagaaatgaagtgaaggaacaagctggagtgggtatctgtgggactagcaaggcaggcagagggaacagcagatgcaggagccccraaataagactgtctgaggaacagacaggacgccagtgtggctggagtggagtaggygtgagagagggagttgagatcagccagatttgatagcaccttgtggctcacggtgaggacttgggcatttgccgtgagatggagccaggttcagagcagaggagtgacaagacaatttatagcatgcccatggagggcagagatttctgtctcttttttaaaaaaattgaaaaaaaattttgtagagacagggtcttgcactttgttgtccaggctggcatgcagtggtgttatcatagttcactgcaacctcgaactcctcgactccagcgatcctcccacttcatcctcccaaagtgctgggattaaaggtgtgagccaccatgcctagcctatttctatctgtttcatttgtcctcagtccacagtagatcccagcccagcacacagtagtagttcaataaacatttgttgcacaaatagagcagatcagtttacatggagctgtgttattttgtatgttccagggtgtggcatgccatgatttatttagcccccccgtggatggtcatctggcttcttacaggcttgtcttaagcattgcgtgaaattaattattacattgctcttagcactggaggaagtgcttaatctgtgttagtgattatcatgactatttgtgttgttattaacacagtgggtgcaagggagacccagatggagatagggctgrgggggcaacctagggtgacacacgcacctggggaggaggggcatgtggcttctatggtggtagcccctccctgcccctgaygcgtctctcctgcctgcagctccacggagaagaactgctgcgtgcggcagctgtacattgacttccgcaaggacctcggctggaagtggatccacgagcccaagggctaccatgccaacttctgcctcggrccctgcccctacatttggagcctggacacgcagtacagcaaggtacgtctggcccaccgggctacgagatgcgcttggggggagccaggacggaggaagaggagagagaaagagaagtaaagtcagagaggtgagttggcaggatggggagaaagagagggatggggtggggaggggaatgaataaagagatggggagagaggcaggaagctagagaggggctctgagcaggggccagagggagatgagctatgaagacccacagagtgaagtaacagagggatgggggtgaaggggagaagagagacagggagatggaaggaaaaaygcagaaatggagagacaaaatgagagagacagatacagacacagagttaggccaaggagagacaaagacagatacacaacaaggcaagaggcgaagatgaggagggacagagactgagaaagaaaatcaggygggcgcggcggctcacgatggtaataccaacactttgggacgctgaagcaggaggatcgcttgagcccaggagttcgagagtagcccaggcagcagactgagatcccatctctaccaaaaaaaaaaaaaaaaaaaaaaaaagctaggagtggtggcgcttgcctgtggttggagctactccggaggctgaggcgggaggatggcttgcgctcaggaggttgaggctgcagcgagccatgatcgtgccactatactccagcctgggtggcagagcgagacccagtctcaaaacaaaaagaaaatcagacaggtggggagagacagaataagataggatgttagaagataagagagaccgaattggagatgggaagaggggatgcggggagagacgaagtgagagaggctggcgcggtagcgggtgggggatggggcagtggagggccgttttcctccctccacgagccctgagccctgaccccgcccgccgcccgcaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcagtgagccctgactgtgccactgtatgccagcctgggtgacaaagcaagactccatcttttttttatgttttttttttgagacggattttcactcttgttgcccaggctggagtgcaatgtcgagatcttggctcaccacaacctctgcctcccgggtttaagcgattctcctgcctcagcctcccaagtagctgggtagctgggattacaggcatgcgccaccatgctcggctaattttgtatttttttttagtagagacgaagtttcaccatgttgttcaggctggtctcgaacttctgacctgaggtgatccgcccgcctcggcctcccaaaatgctgagattacaagcatgagccagcgcacccagccaagactgcatctttaaaaaaaaaaaaaaaaaaagactgggcacggtggctcacacctgcaatcccagcactttgggaggctgaggcagggggatcacttgaggtcaggagtttgagaccagcctggaccacatggtgaaaccctgtctctactaaaatacaaaaaaaggctgggcgcagtggctcacgcctgtaatcccagcactttgggaggccaaggcgggcagatcacgaggtcaggagtttgagaccagcctgaccaacatggtgaaacccagtctctactaaaaatacaaaaattagccatggtggcgcacgcctgtaatctcagctactcaggaggctgaggcaggagaatcgcttgaacctgggaggtggaggttgcagtgagccgagatcacgccacttcactccagcctgggagacagagtgagactccatctcaaataaataaataaaaawaaaaaatacaaaaaaaaattagtctggcattgtggtgcacacctgtagtcccagctactcaggggcctgaggcaggagaatcgcatgaacaggggaggcagaggttgcagtgagctaaagtcgcaccactgcactccagcctgggcaacagagtgagactccatctcaaaaaaaaaaaaaaaaagaacttgcactcaaggaagacaggagccatggcagggtttgacctaggcgctcagagggtccgccgtcttgctcatggttgggagtggacagaagtgtcagggtgagggtgagcacagacagaccagctgtccaggcaagaaatggcagcagccacaggtgggtctccctctgctgtctccatttcttcccmtctgctatggtcctgcttgtgaattctctcctgcttcctctttctcctgcctctcagtttctgctctttctcctaggtttcacttccccacacccagtgattgtcctgggaggaaggacagtatgagtgctgcggttcctttgcctgtgggcatgagagctgttggcagcactgggtctgggtgccagggacctggggccctcccagctcagcataggggtagaaatgtggttactcctctggcctcaggtcccaaagcacacagggctgagggaggagtggggaggcaggagttcactatgcaaggacatgccaacaaatggataggtatagagatgctgaggtctggccccaagaggcagagtcacaagmtaggacacagtgactcggctgtaatcgctgcagccctatgaggatgtggtgcgtgtacacatgcagacacactcacacggcgggaaacacggacggtgccccacactacacaaatattcacctctcagagccgccgtggacacacagagaytcctgcagggcccgtaacacatgggctgtgtcatttggcagcagctgcagcccacatatacacagatacaaatagagaaagtgtcagcccatcacgtaaacaccacccagcctcggagcctcactgggacacaacacgagcagagacttcaatagggacctggcacaacacagtcatatacaaatatattccacagggtcatggtcgcaaccaccgcacaccagacactgattcaaacagtgtcatgcacgcacacgcatcacggcatcagagcccggacaggaaatggatccctcaacagccacctcctcctccatgggttcacagtcacaaacaggtccagggtgcatgtccacagtcggacctgtcacagtcccaccagacacaccccacacagaggtctgacacgtcacaacctcacagacagcaggtcggtcttacccactcagtctgacatcccacaccctccgccacacacgcacaattccagcctggggagtcccacagggccccacagattgcagcgaccccgtcacgtcacgcccagacacactgtcacacccagggtcccagacggagcagacacacccccagggtggcagacgcggccctcacatgcccagccccagctcgtgcctcggcctgaggacaagtgctggctgcacattcgcggtgtggtcggcctgcccaacacgccctcatgacacaccccgcccacctgcccagggctgccggctgagctggcacagccccacagggcggggaggggaaactgtgggctcagcaccttcctctggccgcgtgcgcactgcccctgccctgccaccctggcacccaggcccgatgggtggctcagccccgtygggacaagtctgcccccgcctgtggccgaccgcaggggcagggcagggggtttggggctccccgctycctccccctgccccgcccctgcctctgcaggcggcccggggccacagagggaagtcgtggggggagcctgggttccggctggagccccagcttcctgtccagcccccgtggggcaggaagctgctgggggaggccagctcaggccttcctgccccctcccccgcccccaagacgggcctgggacccgggtcagcaagggggagtggggagattggtgggtgagagaaagccccttcccccttagtctctggacatgcagagtatttgaggttccagtgtggattcggatttgtgtgttcaggaacttattgtgtgcgtgattccaagctttgtggcgtgagctgcgtctggcatgggtgttctgggggcctgtgtgctgtttggtatggatggtcttgtctrtgtgtgtccccagcacgtgttagctccgtgtgtttgtggctgcgctgcatttctggggtgtgcgtctgcattttgtatttctgctgggcaagctgttgtattttctgtgggttttatgctctggcactgtttgattctgcaagtcggccatgtatctggggcatattgtgtgtctgatatttttctcaacatcttcactgttcttctgagtgtaaatttgtgcatttttaagtgtaagtttgacttgaaatgtggtgttttctgcatatgttaatcatctgtgggaatggtgtttctccaggagaggggagtgagtgtgtgtgtatatgtgtaagacggggtcttgctctgtcgcctgggctggagtgcaatggcgcgatcttgtctcactgcaagctccgcctcccaggctcaagcgattctcctgcctcagcctcccgagtagatgggattacaggcacccaccaccacacccgtctaatttttgtatttttagtagagatgggatttcaccatgttggccaggctggtctcgaactcctgaccttgtaatccacccaccttggtctcccaaagtgctgagacacaggcatgagccaccgcgcccggccgtgtgtgtttcttacatatgaggcagatgagttgagttgtttctgggttgcactgtgatcagtgcatgtgtcgctggtattctgagcatgtttgtctacrtggtgtgcatccagcatgcttcctgtggttctcagtgtttgtctgtgtgagggagggctrtacttcggggctgtgtgtccatctcagggactggtgttcccagcctgtgggtgctgtgagcaggtgctaaggtggtgtctgcatgctgtgttcccacatgtaggctggtgactgcagtgtgtggagttgtgtgggtctgttttgcatcatcgttgaggggatttygcgttctcagcaggggtggatgtgtgtttgtgagcagctgcgagtgtgggtccacattgtgtgctggtgttttcaggggagggggacagggtgcgtccatgragccgcctgcatcatgagcggccagtgcctgttggcctccatacccagcgcaggctgtgtctgcggcgcgtccccttgccggctggtgccacgctggctcggagctggctgtggcagcaggcaaggcagggcagggcaggggctgtggtgggcactggacccacgcccagcctcggtataaatatcccaggctgccggcggctgtgtttgctgtgtttactcggcctcagccccggccgggggcggcagcagcccagcaggtcctgggggcgggggtgaccaggccacagcacagacatttccttctggccagacaggccccgcaaccttgctgccccctcctgcgccctttctgggtgggcgagaggcgatgacccctcattctgggtttccagtggccgccagtgaggctccaacctggatatcccagccgggcttcccagagtgtgggagacagaggagatggggggcacggggggsgggccaagacacacagcagcgagagggaaagggcaaagtgaggagaggacagagccccccagagggagactccagcagagaaagggatggggaaacgaggtgacaggagctgagaacagagatggagaatggctggggacayggagtggaaaaggtggggaggagagggagggagggagggagggagaggcatgggaaaaacaagggaggagagagaggggagacggaaagtcacggggagacaccgacagccagaggtgtggagacagaacgagaagacagagcagtggcggtgagggaggaaggcagagggctggaaagaaacgcacagaagcagggagaagggacgggggacagagggacagagtgactggagctggagggggaagagtgcagggaggcagcttgctttggcaggacgcatggaggtgtcagacgtggggggcggggtgkcggccaggccagcgagccaggccagggccaggacggacaggagacacgggggtgggggccggatgcccacctaggggttgtctcccagcggggcccgccctccctgactcagcctttccacctaccccgaccccgggagaactgggagggggatgggaggcacccgccctggggcccaccacccccaggtctcagaggcagtgaccagggggtgtgtctcccgtcatccctaccccactctgtctccacctctcttcctgtctccccatctaatccctgtccctgggactggctccacctctgtctgtcagctagatgctcacgtcttgaccatctgactaaccctaattctgactcaatttctgtgtctctcatcgctttttaaaaacctacacaacaaatttacgtatagcaaagtatattgtaaacaaatttaatgaccaaatgatagaytggtaaaaaatgtgcctatcaccaagggctgatacctttcctgtggcccaggccctctgctctttaaaaatggggcacaaatacaggcaggtaagagacagacagctctcatcctgcactcttggctttctgagagrtatgaccccaaggtcctggagtctagctgctgcttcctcctctgggaaatagaggagtgatattggtagtacctagggcatagcactgctgggacaattcagtgatttggggactgatctccatatcaagatgacctgatcctgtctgtgtgcgggacagtggctagcasggagcccttgttaggcccgcctaccatctgacccttctcaaaccttcccgtctgaggacatctgcatgcacacttgtccctccaatgctgtctcactctggatggccctgacacctgagaggccagacagccaagtggtttctaggacctttgtgattctaggcctgggttcctgtttcatttctgcctctgatggccgagtggccttgaggaagcaacatctttccaggcctcctttgacccacttcactagttcatggggccatctgaggatccaacccggtgtcaggcacttcgctcgggcctgacagaggacagaagcgctccgtagcagaggctttcgttctttaatag

SEQ ID NO: 13297 - DNA, 21963 bp, Homo sapiens
cagtctcaggtttgtctttatcagcagcgtgaaaacagactaatgcagtaaattggtaccagtagagtggtgcactgcctaaaagatacccaaaaatgtggaagcgactttggaactgggtaacaggcaaagtttcaacagtttggagggttcaggagaagataggaaaatgtgggaaagtttggaacttcctagagacttgttgaatggctttgaccaaaagcttgatagcgatatggacaataaggtccaggctgaggtggtctcatatcgagatgaggaacttgttgggaactggagcaaaggtgactcttgttatgttttascaaagagattggtggcacttttcccctgccctagagatttctggaactttgaacttgagagagatgatttagggtacctggcagaagaaatttctaagcagcaaagcactcaagatatgacttgggtgctgtcaaagcattcagttttataagggaagcagagcaaaaaagtttggaaaatttgcagcctgacaatgtggtagaaaagaaaaacccattttccgaggagaaatttaagctggctgcagaaatttgcgtaagtaatgaggagcagaatgttaatccccaagacaatggggaaaatgtctccagggcatgtcagaggtctgcatggcagcccctcccatcataggcccagaggtctaggagaaaatggttttgtaggctgggctcatggtccccgtactgtgtgcagcctagggacgtggtgccccgtgtcctagccattccagccatggctgaaagaagccaacgtcgagtcaggccgtggcttcagagcgtgcaagccccaagccttggcagttgccacgtggtagagcctgcgagtgcacagaagtcaagaattagggtttgggaacctccgcctcaatttcagaacatgtacagaaatgattggatgcccaggcagaagtttgctacaggggcggggtgctcatggagaacctctgctagggcaatgcagaaggaaaatgtgggttggagcccccatacagaatctctatgggggcactgcctagtggagctgtgagaagacggycaccgtcctccagacccctgaatggtagatccaccgacagcttgcgccatttatccggaaaagccacagacactcaacgccagcccgtgaaagcagccaggagggaggctgtaccctgcaaagccacaggggcagagctgcccaagaccaagggaagctaccttttgcatcaacgtgacctggactcaaaggagatcattttggagctttaaaatttgactgacctgctggatttcagacttgcatgggccctgtaaccacttcgtttaggccaatttctcccatttggaacagccgtatttacccaatacctgtaaccccattgtatctaggcagtaactagcttgcttttgattttacaggctcataggcagaagggacttgccttatctcaggtgagactttggattgtggacttttgggttaatgatgaaatgagttaagactttgggggactgttgagaaggcatgattggttttgaaatgtgaggacatgagatttggcagggccagaggcggaatgatatggtttggctctgtatccccacccaaatctcatcttgaattgtactcccataattcccacatgttgtgggaagggacccagtgggagataatttgaatcatgggggtggttccgccatactgttcttgtgatagtgaataagtctcacaagatctgatgcctttattgggggtttctgcttttgcgtcttcctcattttctcttgccgccaccasgtaagcagtgccttttgcctcccaccatgattctgaggcctccccagccacgtggagctgtaagtgcatttaaacctctttctcttcccagtctcgggtatgtctttatcagcggcgtgaaaatggactaatacactgtggttatgtattatagtcatatgatatkttcatatttttggaagctgggtgaagggtagatgtggagaccatgatttttgcaaatttttttaagtttaaagttatttctaaattagaagtttaaaaagaagaaatcacataagccataacacaatrgaaagatgtctttaaagttcaaggcaggagggatgtctggaaatcagcgagaaatttgcacctgtgtgtgcatgtgcatatgtgtgtgtgtatgttgcaaggacttggaaagccctttttttcctacctctgtactactgtggggggaggctaaacttgacttcttcccatcttagttcttttttgggatagactcctgtaacaaaagacagacaagagaaaaatcagcttacaacatgggccatgcacttcacacaggagaaacctgcatgaaaagtaactcaaaatggtgccttagaactccacttacctttagtaaagagcaataaattagcaggaaaatcatggatcgggacaagggaagtggttttatgcttccaagggcaggaaatcatggaaggtaaatatatgggaggaaactaaaggaataaggcttgtttgcatattcctctgatgccatctctgggttgataagagtctagagtcatttccagtaaagatgaatttttatctgtctttaggaagaaagggggaaagatagagaaaactatttctccatttgctgtttcttaattaccttcagttcaaaaataatttttatatcagaaaggcayatttagaggtatgttagtttattttcacactgctaataaagacatacccaagactgggtaatttataaagaaaaagaggtttaatggactcaccgttccacatggttggagaggcctcacaatcaaggcaggtcttacatggcagcaggcaagagggagaatgagagccaagygaaaggaatttccccttaaaaatccccttataaaaccatcagatctcgtgagacttactcactaccacaagaacagtatgggggaaaccacctctatgattcaatgatctcccactgggtaccccccaacaacacgtgggaattatgggagctacaattcaagataagatttgggtggggacacagacagaccatatcaaggggtaacatagtctggtttcctttactacccacctacccaaacacccccttcatctgatccacacaaagtaaactcttgcagttctctcactgtttcctggagtctgcttttggtctcataggactgccctaacgcttgtttttcagacgtttaaccctgtaggtctctggacaaatttgctttagaagcccctcgatgtckccctgaagagtggctttcagaagttgtgcctcctgcctgaggggagttccaggaagggttctgcatcgcctatgagtttatctggatcaccagaggccttcccgtcagagctttcccaatcgtttttggccaaggagtgtgagaagctaaagttcataacaactggaagtcagacagcctggtctattctgctttaactctagcaggaaaggccttcatggtggggcctgaatatcttcctttataaaatcaaagcctggggacagggttacytacttctgaggttcaatctggctctaaaattatgcaacaaatgccattcctttagcacttccttcctaccgggcgagatactcaactccacaggcaccacctcagttcatcctctcagaagtcctaacagctcagcctggggcaccccattttacagattagtaaactgaggctaagagaggttaggtagcttgttcagggtcatgctgctggtaaaagagctcaggctacagtgctatgcattgagttttctcactttcccatctaactggagggctaaaggtcaaagagtgggcagctcccttgttgggagctgtacaggaataatgtcctccctgaaggagggggacttctgagccacaccctggggtccagggctcacagccttaggagcaaaatcgtccacccccttcctggttcctcggtgctgcagagatwttcataggacagagtctgagttctggccacttaacagaggaagaaaggctggctcggtgaggttaacttacatcccagcagctaggaaccgggagcagaggacctcagattcacaccagggcaggaggcaatggcctggctgaagccttcacaatcttcccaatatactcygctgccttcctttrtaaggatccatttctgaaaccctgtgcsctggccaggcacggtggctcacacctgtaattccagtactttgggaggccaaggcaggaggaccacgaggtcaggagtttgagaccagcctggccaatatggtgaaaccccgtctcyactaaaaatagaaaaattagcgtggtggcaggcrcctgtaatcccagctactcgggaggctgaggcaggagaactgtttgaacctgggaggtggaggtctcagtgagctgagacagacagtgcctgggtgacagacagagactccgtctcaaaaaaaaaaaaaaaaagaaagaaaccctgtgccctaagacctgcacactcgctggctccgctcagacatttagcaaagcagacaccttcccaggcctggaggaaacagcccctgctttttgggaatccacaagcccgcagctgcaragctcgacctggatgggcaggcaaaggctgactcctgtgcgtggtgtgagtccagcctggcccctctacaccctcactttcacctcttaaagaactgcctattaacagagcaggtactgcccaaaaggaacactctggaaacttgttgggacacttctgcctttcacaaacgtttggggggagtactactagcatttaaggattgagggttagcaatgccagacataccagaacacgcagggcagtctcccatgatgaagaggccgccgggttccccaggactcacatgtccacctcaagttcacgtgggattatctgagcctagactgtcagtcctggggctgctttatttcatataaaaatataatatttatccaaggttttactacacaytgcattttctgtgaagacaatgaccgtgtaaatcagggaaagatctatattttattttgtttgaaactttaccaagcattatttaccatttcaaaagctctatccctggtagtaccattggttttcttgttcaccggccagcagtgagcagcacacaagcgacctcccgtgggctccacattggacagcctcactgcacctgcccaggcccttaggccacagcactgccatattcagggacacattattctcttttattatgcctccatattatcattacagcattatcttttttttaattttgtgggtagattatattagctatacgtttcacttcaatggtagtagtaaggggcacataacaaaatatttacttatatatattaaaaaagagagtctgagaagtctgaaaagttttgccataaacggtctccaccagcctcaactctgagtgcccraggattcagtctcaagtccagcaacattgtgaagcaggaaatttaccttgaaaggagctatgtactctaagtagtgatttacctgtctgcctcccccactggattgaccagttccttgggggctgagagaacaggtcctgaacatttctgctgtgccccccarcccacatcctcatagtgtccagtaccaggctggggactcaggaagcatccatgggatcccccagtgccttctttctcgaggtgttcagcacctagaacagctcaagacaaattccccacaccccacccagacagagctgaatcttactggggmgaagccttgagttgcaaggcagaagctctcgtgatgggatttgggtcatattccgggttataggaggagctggggagtatgggaagcctcccacttggtctttggttttccagaaactccaccatcacaagcaggatgttaatcagtaaccgtyccacaggggatcatactttggaatagcaaatatttgctgaaggttctgggctgcaaagctgaagctttggtttctgctctaaatgaaggacttttccaggacccaaggccacacactggtaagaggcagtgggttacaggagaccttcaatgagtctaatcagggagggaccgggaaggatggtatcatccctgggygggctccaacgtgagggctgtgtggctgagcagtgcaaagacctccatcctacactccacagggactgtacatacagmttgggagctggagtggggtaagaggcraattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggakcaccccctgarctcctggcctagactccaaagggttgggtagatgagcaaagactttacaaagaccttaggcgatatatgtccaggagcacccaggaattactgggctaccactgcagactgcaggacaagctccaagaacaggaaggtaagactcagcatttggaggtggtgacatctagttggcgtgctgggctaatttcctgaccattgtacagggrgaagtaaccttgaattcaggagtattctgtgtggtcttaatgtagaaagtagcactaaatgatgccacgtaatcgttttagctcaggctcctctaacaaaacaccacaggctgggtggctccaacagccattgatttttcacagttttggaggctgaaagtccgagtcagggtgccagcgtggccggattctggtagggctgtcttcttggcttgcagatggccaccttcgcaccgtgtcctcccatggagaggaggtgcggagggggactctgctctcttcttatgacagcactagtgctatcacaggggccttgccctcacgacctcatctaaacctaatcacctcccaagcgccccaactctattgccatcacaatggtggttcgggcttcaacttattaattctcaggggacacattcagtccataacaataaaagcgtgaaactgggctgcgtttacactgaaagagctatttacccaacgtttacaatacttgggtgacctgttgaatgcaggcttgccatttagagtcaaaaagagcttcctcaacagtgtcctttgggaaacacagtggaagtatttcactgcttctacaggggagagggtagtgccgttcagactgcagagtgaggccctgaattccggggtgccattcagcccgagcaaggggcaacatgctgggccctggcgctggaggcggttttgtcccaggcatagataaggactcagcccctgcatcaggaagaggcctggcagcaccgcctgtcaatacattttgccgcaggtgaccttggtcaagaataagggtctctgctgatgggaactactgtgaggccggcagcatccaccctgcgctcactgggctgggtggcctaccccacccagaccctcccagggcagtgggcccagagagaggatgagggagggcaggtgtcccaggggttctgcccagccagcctctgggatcaggcctgcagtgtggctgaacaccagaactgagtttggacacagccaggtggcccaggccagtcccaagccatgtatttggatggaaaacatggaagtattcaggagccaggctctgtgtccaaggatgtggagggagcctaaaaggcgacagagaaggggacagctaacggtgaagaagtgtagctcccacactgcagcctaggacagtgagaaccggcatgcagcccaggtggctgagggctctatgaagccacagtggagggagcccagaagtgggttgtatgaattgcggggcctcctgctacccgggagctgcagctataggaaggaaggaaggaaggaagacctccaaggaactgtgtagcagaggtgcagtgcaaagagaattttgataaaaaatcyaggaaagctccaatactttcccccttccttgcctaacgggcatgcaggcactccaatccccagccaaacagggcactgggcaaggccggccacccatctggatgggcagcctgacgaccagatggtcagggcagtgaatgaagcagatcaaggaaaggtgtgtgaggacccctgattccacctgcttggacccccaccttctgtgctgcctcctgctcccagagtggactctcttgccctggccctcagggaggagacgggatgaatgaaaacggggtcaggactgagagctgcctgccggcctggcagggaatgggaactggaggaggttttgctctgtgaaataatgtcccctctttgggtgagcaaatgtcacccacacttgctctaggtctccctggggcagggctaacctacttgagccacaggaaggaggcagggtccctgaagaagcttttactatccacaaagacattttaggaggcattaaaacyatctctatcctctcctctccacaggaagtcttgcagctgaagggaggcactccttggcctcsgcagccgatcacatgaaggtggtgccaagtmtcctgctctccgtcctcctggcacaggtgtggctggtacccrgcttggcccccagtcctcagtygccagagaccccagcccctcagaaccagaccagcagggtagtgcaggctcccarggaggaagaggaagatgagcaggaggccagcgaggagaaggccrgtgaggaagagaaagcctggctgatggccagcaggcagcagcttgccaaggagacttcaaacttcggattcagcctgctgygaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaacwgggcctcwcacaggggagttttgccttcatccacaaggattttgatgtcaaagagactttcttcaatttatccaagaggtattttgatacagagtgcgtgcctatgaattttcrcaatgcctcacaggccaaaaggctcatgaatcattacattaacaaagagactcgggggaaaattcccaaactgtttgatgagattaatcctgaaaccaaattaattcttgtggattacatcttgttcaaaggtactttgataatgttctgctctcccaaggccacagggccctacgattgtctctccctttcctttygttaggccagcatatgattaacgctrcrtgattttctatgaatgtgttttcacgtttcaaaaacagattgatacacatattgaacagtgccagaygctgtcatttgaggcccttccctggtatcctatgtgcttgtagtccttattattttcagagcactctacatagctcccctctgacacttagaagcatagggtctttccaaaaaacagggggctgggggattatctgggggatttaggattgcatcattgctccttcatttttactttttgaccaactctctgcccttagattcctattatagaaaatagggacactccacctactacagtgttagaggctaaatgagacaatgaatgtaaagtgcccagatgggcttggcacatagcagacactgagtatctattgtttacttgttcttccaaactgccaatcagcaggtagagcaggagttgtctcctttctaaagatgaaaccagctcagagacgttagcttgatcaaggtcacacagtaagtggcagaggcaaaacccaaacaagggcctcctgaccccctgatcctaggttctgtccagccctgcctccctaatggggcactggacgtgggttggatgccactttcgcagagctggcaccagacttacaaagccccggcaggggaagccactttacaaccagccaggccacacccccagggcagacrtttatgtagagagtaatgtacctgcctgctagtagcctctgcattgtggggccttctctcagaaccacactaaacagtgggtgggtgagaagtgtcactcctgccaccttggactctgcatgtgcttgtgcctggtgtgaatgagacaaagtggcagtcagaggtgccaggcaaaggcttttctctaagctggagccaactatgagggaacgactgtgaattccgttcaggtccaggacaatgagaggagccagggrttgttaggaaacatttccctgctttcgtgtgcgattcccaatagggcctgcgagtggagctgcattttgctagctgggctagaggacggggaaaattttggggaaatttattttgcctgcctgagctgtggaaaagccaacccaattagggaacgcctttcctagttggaacgagaagacgagaagtgagagaagtgagatagaaggctccctctctattatttgagcaagaacaatgcttttcraagagggaatttctgcaatgagttcttctcttacttgttcagggaaatggttgaccccatttgaycctgtcttcaccgaagycgacactttccacctggacaagtacaagaccattaaggtgcccatgatgtayrgtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccaggtacaactcttgcccacaccctatacaaactctacctttctgtactggcaaacgctcagcacaatttcattgaatgcaccgtgatttaatgtctcctccagtgagctataagtttcctgaaggcagggcagcatttgtctttttttccactctatccccagcatctgtcacagggtgcctggctgattcattcattgagtccatcagtattttacgttctgcgactgtgataaatatatgatgccagggatccatcagcaaacaaaacaggcaaaattagtctgccctcatgcagcttacattctaktgaaggaagacaaagagtaaattaaaaataggtaataatgcagggaaggggacaagaagcatcatcaggatgcagatggaggttagacaaggcctctccaagaaggtaacagtaagcaaacatctgaagatgaaggataaaccatgtggatatattcggggagagaagtgttatgttacaggcagaagtgtacaagttctgggatgggagtgtacctggtgggtttgaagaacatcaaggagacaagtgtggcttcagcagttggagataaaatcagagaggaaacaggggcccagtccccagaaaagacttgggctttcctgagagaggcaggaagccactggatggttctgagtagaggagcaacctgattttgacttctgtttttaaaggatcacataagctcctgtgttgagaaaagacactagggggtaaggatggaagcaagggagagtggttagaaagttactagcaatccaggtagagatgctgctacctggactgcggtggtggtagtggaagtggtgagaagtggctggattctggatctattaggaagtgcaggatctgctaatcgattggatgtgggtgagagaggtgtcaaaggtgatcacaaagtttttggccttagcaactggaaagacggatttgccatttactgaaagggggaggaacaggtctggggtaagtgcagaagttcagtcttaaacacttggatcagaaatatctattagacatccaagttgagatgtcaagacgacaggtggatctggagtctagggtgaggtccaggccggagatataaattcggtcatcaacacagaactagaatctagacacatgacagggttggggtctgtaaatatagaggagaggaaaagaaagcacagagtgggcactgaaatgtctgcccaataaattaatccacctattggagtacaaggaaaatggctgcaatacgaattccatggctatggcttctgaatcctgtgactcagattttggcagacaagtgcagctaaaggtccccagggttagttttatcttcattattcttctttcatttttcttcatatctttagcacctaacaatgaaccccaaacatcataagccctcaagtaatgtttgctgaatgaataactttttaaattaatcttcaagacacgtcatgtcctcaattatttttaaataaataaaaaaattttattttgagccacagaactcatcttttcaagcaacatattttcaaaggaggactccagtatacaaaatagatggtatcagagcttctctggctaaagacgggtaggggttgaaagttttctttgctcccctccccatccatccccagactcctcgggtctgcagaatccaggagctgaaaacagccatcatccaggaggctgcaggactgctgaaagcagctgttaactcaggttttttttaaaatatagggaaatgaacacataagtactttgctaaagaaaacgtgagtcactggctgaggaataaaactcattcactgaagctgaagtactatttgataagctagaaatattttccctgagtagaccactgtaaaagaatggcatgaactacatagtcaactgaaagactcattaatggaaataatcttaaagaacaaamattgtgacctttttggtgtccacagactagggctttgtctacatttcaccatcatctgttcttgtaccacagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggtaagtcaggatctttcatcagagcccaacctcagcatgaaatgtcaccaaaacaaatgcttttacaaaccatttaactttgataaaatacctaattgtagtggaaaattagatttaagtcccaaatacttgaaatagcacccaggttggatgttttaagaatttcaagcaacttcattaaaataacttttcaactaatttattttaagcagacctctccccctctgcttaaagtgctcagggagaaatttgaccctgaaatagaactggtttacagaggcatcatcatttatgttgaatacaactkgaatagttcatgaaattacaccacctttacaatgaaacaaacccctagacatcatctagcccaacttctccctccttgtggaaatcccctccatagccctacgaaatagccctccaacttctcttcctcttcatgcttccagtgacatcaaactcaccatttctttgaagagctgcccaatccacaaatagctaaaattgttatatgtatatatatatawgtgtgtrtatatatgtatatatgtatgtgtgtataaatgtatatgtgtgtatatgtgtgtgtgtatatatatatacacacayatatatatatatatgsagagagacatacatatatatatggagagagagagagagagagtcctgtaacttctgattcatactttttggtcctagttctatctctaaaacttctaagaacaagtttagtcaccatccacatagaatcccttcagttactcagtgtttctcagtggaagggttcttggttttgaggggaactgcttgttgtccagagcagttgtgcatgttgcagggaactggttagcattgctggcccatgttcactaatgccagtaggaaactccagtcatcactataaaaatgctcccacacatttccaaatggcagctacatctctctacattcttccttagctgtgtggtttaatattttcttatacaattgcaattttcaattccaagagagactaaaaatggcatccacttaagtaggacacagtagggtaactgtggcctggaatcaggtcttacaacctcaagagaggtaagacaattaaataaaacaatccgtcagaccagcacctgaaagtgtttctgctatgaacacatgaaaaactgaaatgcgctgctgctttatgaagggtcatcatgaaatttaaactgtaaatgattaaatattctccctctgtttgctctggggaattaattttcctctaggaaatcagggaatttcctggagtgaaaatcagtgtaattacatgttatgttttcattatctcttataacacagtaattatataggtacatcactcatatcacatcttgtttctgtaaaaaagggcctcccaaacatagcaagcagccacagtataggcagccagaattcagkaaggctccagggacccctgggcttggcccagaaaaatgcctcagagtagtaccaggygytgggaagctgctacagaagactagccattccctgcctccaccttgcctgccaaaaggaaagtcagaggactcaagggatccagggatcaagggatccaggcagcttgaaaaccttttaggagcaccagctcagctcaagaattagtagcataaattacatgctcaataaagatttgatgcatgagtgcatcctgagtccaygcccggaatgtgtttcacatattccacaatacttcacattgggttcctgaggtctcctggtattgtttaagactcctgtggcagtccctggtgcaaccccagaccactcctcttaacgtagatgggcctgctccactaaatcccaggagcatgaccccatgggtaggaccactgtgaagaatttcaaggggctcatttaattcctcctttgcactgccacacaaatggtttttcacattatttcctttttccaggttttacraagaacagtgattgaagttgatgaaaggggcactgaggcagtggcrggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacaygcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaaygcaagcactgcaataccataacagtcaaactgattatagagaaggctactaagtgactcatgggcgaggagcatagacagtgtggagacattgggcaaggggagaattcacatcctgggtgggacagagcaggacratgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaagatgtttgtgcaatctgtctggtattttaagcttgtttctaagaaccttagttacttggctaaagactagctgggtagaatatcttttctctgttgctcacatattttcatttttaaaaagttgcagatgagaacactatgtcaagataaagcctttgggaggaacacatgtaaacattctccttgagtcatgtgcttctctctctttccttctctctggtgcaaaataagtgttttattttaatctattacggagtcatttcttgctgactgacatcagaagaaaatagctctaaccagtcctgatcacagcatctgcttccatggtgcatcaaatcgcttggcagaggcattggctgaatcacagatcatctagttcaataccttcattttacaaaggaaagaaagagggacccagaaacaggtccatattcttactttcatgggccctaggcacgtttaaccttgtagactcctccttccttcatgaagatatatatgttctatggctgcattggtagaaagatgaatatattcgtctttcaaagttgcatatctagcttcaaagttatatgtctagcatatggcaataagcaaaacaccttcatgggcccttacagtactgtcagccttgggcactgtgtcttctgcatctagtggataagtcataccttatataccagtgggaacaaaatacttgtccaaggtcttccagtgtggcaatggcagagtcagaagcctacctttcctgagtctagtctccaagccctttttactcttccttccatctaaaacatctgatggggaccaggtaaacagcatgcactacagctacccatgggggttaaacagaatataagcayraactttgtcccagggtgaaaaggaaaatcgtaaatatccctgatcttccttaggcagttattttctgtcacagaaacagaaaagactatattcagagaatcctgaatagagctgatttacagtgtgaactatgttaactaaatgcctaattggatttctgtctgtctgctatctaatgtttaaaaaaacctaaaattcatttattgattagttgtttaatataattcagagtaatgtgaataggtaataatattaatatgcagtctaaatactgacttttcatcattccataacctggactgatgaaaagtcagtatttagactgcatwwtaataaaataaaattcattcctgtattcattccaagagtactaattgacacttatgaagggacaggcaattctaggccctagagggccaaagacagaggactaactctawctgacattcttaagtcaccttgtttgtgttcaattagtcagatttgtttgtggaaaaatagtagaaagaggaataaagtagcatccagtccaatttcccacttttaagagatgaaatctggaaaaataagtctgtgagagcacaatactcactgaaatcaatatggccaaacccagtaataaaaaggtacattattattgaaggattcatatagcatgcagataaaaaactcctgccttcttcccaccacatacactgcaaagcaacaacagcataataattgtatttaatatactactctttaaggtagaaaatggacctattctatattttaaatatactttttaatgttcccycacatttgctttaagaagttcytaagacactcagtttcagatttcccaagtacacaggcatgacagaaaaacgcasaccaataaaaaatgtaacttaccttacacaaatacatacacacaaattcagggtttccaaccgagcgggggaaatcttaacattgtagaagtcttcactatatatgtgtcgagtttttgtttttgtttttgtttttgttttgagacagagtcttgctctgtcacccaggctggagtgcagtggtgcgatctcagctcactgcaacctccacctcccgggttcgtgccattctcctgcctcagcctcccgagtagctgggactacaggcacctgccaccacgaccggctaattttttgtattttaagtagagatggggtttcactgtgttagtcaggatggtcttgatctcctgaccttgtgatctgcccgcctcggcctcccaaagtgctgggattacaggcatgagccaccacgcccggccaagtgtcgagtcttaaaaattgttcctacacagacacactcaaccacacgttctcacatatatatgctgtaacaactgagaacaggttactgacttaatctaattcattctatcttcattgtaaaacttccactccagctgaagagcctgtttcatttcaattcaaagatttctcatatatccactaattgtatggcaaaactgactcatctccagactaagatattcaagctcaggaagtcaaataatagaaatgattttttaaatgtgtaagaggttataaagaaaaactttatgtgctccttatttaacctctattaagtaaaatcctttatagacctatctccatttctgcagtaaaagtgagctctacagttagcttgtaaggctaactagtgaaattcctggacttgttcttaaaaatgcaagttttagtaattaacaaaatgatgatgaagatgtcccttttccctacaactacagatggagggagatttttctttgccatacaactagcttaaaggattaatttgataagttgttaaactgagaactttcacaaaagtatccatcttgtttttgatataaatggagatacatgtagttattcataactgtcagtaatttgctgtttatcctgtttctatatatctgtccttgagagtataattttaataaatatttcaaagattttaggaaatgtcatgttctgttaaaaaacttccaaaagtaattttgatgaacagttttgataacttagtactaactaggactaagactgcaattgactgctctacattcctgaactttataagcagtagttgtttctctctgtcaaatcagtgtccccttttcccatttgcatcatgggaaagtgaaaccttataattctgctaaatttattataacaaatacattgaaattctccattttattaaattaatagaatgttatgaatcaaagcaccaaaaaaactgatgcaattttgatgtctcgttctgtaccacattctccagatcttaatatattcagttccacattattggtgctagtaggagacataatgaaaacagttaaatgaaatccacagcgagtatactgattaaccagtactgtcaaatttctcatacctattgaattttaactactgacaaaatgagcagtaacaattccatttacctgattgtcctttggcaaaggatattattaagaatcactaaaaatagccataaagaagccatatggaaggaagaaggaaaacaaatggcatgaaaaggtctctcactgagtaactatgctcttatagttgacgctggtatatttcttttattcactacctaaaaatgaactatcttactctttaattatagaataaaaactgcaggaaagtatttaagactttttttcacaaacacaggtatctcattaacctatgttttattttgagtaaattcattattcattatttcacattataaaaagtaaccacacatacatatgcattcacaaattagatcatctttatcatacatcaatatattttaaaaaacaaatatcttctaatatcaatatagttatatgctgattgcattttgaaatagagaagctgacaatagcttcacacggtatatctcaagaactgacagtttaaaattaagaactgtatatattccacaggcaaattttgatggaaatattagcattagtacaaataaatgctgttgacatagcttaagcatgatagcttggaataacagctgattcagactagattcatcattttaaataaagacaagtacaatctaaaatgtaaacaaagtatttataaaataaattctctaggaaataaagaaaatcatcaatctattatttttaaggtatttatagctcaaagttaccagaaatctttgtggaattttcaytgccaaatttaaatttgggaatgtccgggtacaacatattgtcaccacaatccggagggccgccaaaatcgcagacggctatttgcatcctttcagtgtgacttttcaagtgggcttggagactcatgagaaaatgcagtatctttctcaccttccaagtccccctccaagtgcttatcaagctaggacaattcagctgatgtagactttcatacgatttttaaatgctaaaactctagaacaattaaatggctggtttcctgcacaaataaatgcagacttgtctcttttgcagcagtggttaaagcacattcctagagatgtttttcattacacttcactataacattggaattccgtaaccacattattactcaagaaatatatattatacctcctagggaatctaatttgaaatatgaaaagtttaacatcagctgtcattatgtctctctttctgctcattaacaacaacaaaaaaaaaaacccaaaatttaaaaacaaagccccagccactgctttagcttttgtgtaccaatcacattatctcctgctgcctttgttttgcctccttcatcaagcagttgatttaaggattggattttctggattttctttgggaagaaagaaatgaaggaagagagggagggtggggaaggagggagtgagaaagggagaaaaagaaaaaaatatgaaaaatgttattcatataatgtgtacaaagtaaattaaaaatatatagatactctactttgaataattctaatatatgagaagtctgattaagggaaaaaatgaattacacattaaagattacttggaatgatctttaattaccaaaaattctgtgtatatatataacatagcattcaatttaattcatatttttcctacatttttaattttgtataaccataatggaagttacataggcataaatatatgaactgccttaaaagacaagatataataacatacctatgcttcctttaagacactaatattcctaaataccaaatgtgtcatctcaatgacactgaaaagctggggaatgtattgcatagaatttgagaagcaaaaattaagataaattatactttccaaaatcacctcataggcttattttaaatgaaaagaacatattttcacttggatatggcctgttttgaattgtggatactatttcacagaagaaagaccaatgtggatatcatcacccatccagccaygtggcagtgtgcactcaagagagatccatataagtgccacatcagatggaaatatagttacaaacttgtatacccagtcacaagttaaaaaagcaactgtggatatcaacgtccctcctttagaatcagaaaagactaaataaacctgatgtgttatcaaaatgtttgtttctagattcactttttaatcaattatacatatatataaattatataaataactacatactacgtatgttgaacaagaaaaaattcagtctatgaaaaggaaaagcatgctcaacagtgaaacaacagataaagagagtaatctgaaagaaaggagaaccagcataaatatactgggtttcaatggtctttactgtaaaaaatgcctatggcatttagaaaaatatagcaagtggacaagagattacttttgatgttactaaatatgctcttcaacagaagaatttcagggcaatcttttcagaggaagagggtttagggtaataaagaggatttcaggatgccagagctagaaggcaccttagaggaggaggaaccatgagacagccctgtcatgtgacagacatgcacagcgagggccagtgcgctgagttgaactttgcacaaccacttagctgctgctgggaacgaggcacacaaagctctctatacaccattaccatgtcctgcctctgttttcatgac

SEQ ID NO: 13298 - DNA, 86131 bp, Homo sapiens
gggacaaggtttgggaaagtttgctatcagccccttgtaagattaagtcttcttaaatgcaaggttcctcaattctgtgcagtgtccacgtggacccacccacataycatgagctgtgggaatgggaagaggggtaaggggaactggtgcccacactgactgctgggccctaagtaatgaagccctaggtgtctaaccgaggagtgccctgtcttctgctagcatctgtgaaattgtgggaggttacctggttcgttctcaagtagagtaaatcttcagcccttcatagtccttgacaaagcgttgagaaattgactagtgagtgactcaaactatgcagtaaataatagtagagagcatggtgtactaacaaaacaaaaacccatttctaaactgagaagtttgtaatccatccagaaccattgttataatgagctcttttcgcttccaaatagatttgcaagaacttgtattgagtctatttttaaaaatatgcattatactctgaacactgaaaaggcagagttttctaagtattgattcctgtgtcattcaattgtgagagcatttgagtttcaaaaatgttttcaaatgctcctgtaattttcyttgtggggtggtgggaggagtgaaagtttactttcactgttggtaaaatgtctaggaacagaaggtctgaattaatagcctagttcctgcaatagcaatgattataagggtaagtttgagaacataaaaggttcaggatcctaggctaagcatgatacgtatgttaaatgagtaaactgttttgaacagagttgagcacatagtaagtgcagcataaatatttcttattcttatcattaccttatctcattcaatgaaatacaaactcttgtgttcatctctcagagatgagaaaatcaaggcttaaagaggtcagtaatttgcccaaggacagtggttagagtatttttggctgcaagcaatagaaaatgcaatgaaacactaatgttaattgttttacgtagaaagaaattcagattggctgccttatcagctctcactatgatcaagtagcctggttcctttctgctgttttccttgtcatcttcagtggatcagctatcacactggacaagcttctcacctcatagtcacagggtggctgcaagagcccaacctttcctagaagttgcctctgcagatttccccgcatgtctcatcagtcatggttgggccacgtgyccacccctgaagtgatcccaggttccagagaggaaaccaatgttgagcacacaaatacatttcaagtgctgtcctacacaaaatcagggatctgcccacgaggaagaagaggcggtggagcttggaaggtatgcaaccatggctgagactgtaagagccacggtggaactccaggttctgaacctcaaargttccactttccattgtgatgaaagcatctcaggactgcactgcccagcttggcagccacagcctcacatgaccactgagcacttgaaatgtagttaatatgctaagaaagcccatttaaatttttattttcaacttacttaaattcaaagagccacaggggtctagtggctcctgtattgacagcacagggccaccttgttagtggcatcatttataaccctgggcagcattgctataggaatagccayatcctgtaggtctataatgctgtagaaatggaatgtgtggtgcgaatgaaatttaaaatttaagtagccacggtgaaaaaaaaagagaaacaagtaaaattcatttcataatatgctttatctctatttccaaaatattatcatctcaacatgtaagaaatataagaagtattcatgagatattttacattcctttgttcatcataagtgtttgagatcccatgtgtgtctgacacagcacctgactttgaactcaccacatttcgagtgccccatagcccatgtggccatggtttagagatttcagaaagcattcatggaaaattctctttcctgatcctcattcactatcctgggaagtggccagataaggaagcaaggcccagaagggcccagccagtggctctcagactccagagtcatcgagtccctcactcgagggcaggttaactcacagayggctggcccccaccctctgcatttgccatccagcaggtctgggtgggtaccaggatgcggattcgtaacaggagaggctgatgctgccagtctgggtccacattttgagaagcattcctccaagggtyccacccacgctcataccccagtaagtagatggctcagaattgaaatccttgctttccatcttacatctcattctctttatatgcacaaccatgaagccaggttgctaagacagtctgaaaacaactaccaaagaacagaggtgctgctcatggttaccccagtgtgctgcagcccctgtcctccagacagtgacagcagagtggacctaattttgatactttgtaaacattggaccaatgtgacctatcctagtcccgtgcctttctctggctgacttttcttttatctcatctgattgtgggwtcaatttatttaaaggaaaccatttaatgaaatcttaaggaagccctcacctttatatttggtttaacagttgagtttttggggtacagctgaggtctctatcattgcaatgtctagggtgtccctgaagttcaggtgggaatctgaagacactttcctgatccacgcaggcgacttcagacaatgtcctacacttagccacgggtaaatcatgcttttartatgctcaatggcagaactggtcaaagccactctgagctgctgagagcacttcagattattttccacaccagcaggcgatagaagtggcattcagggactgctgtcattgctgctgagatccaagactcctcttggtgcactgtgatttgcagggaaakctgtgtctctctgacttgcaggccagaggttctgaagattgcttgaggttgcaagtacctccaagcttgagcagcagttttgaagtgtggagatgggaggtgagttattcacatctctaacaaaggagctgctgcttctggcttcaggaggggctgagaggcccytgattcactatctcatcactgggctggaagctccacagggatcagttaggcctgtgggccatgctttcagcacttggaggagaagatcccttagactcagcctttggctccatgccactcttgacmatgtacagggaagccacttggacctgatgctggagtttaatcaacagacaaggaagaggccccagtgtgtactgggcaaaagaacgggacgggtgtgctgaaaagcgtctcataaacagactttgttttcctgtgttttaactcagcgtgaaagtttctctaggtctcctctcctgggggagaaaggtagcggctggtttcctgttccattgcttctttagtatcctgagagagaacagccatgggcacccagctgcccmagcctcttcctgtcccrgggccccgaggctgcccttcagcggtctccagcttcctgctcctgtaagcaggggcctctctttttggctttcctgacatttctcctgacctcttctgctagccctcctgaacgcacagtaatatctgtacattgcagttggtccccaggctgctgcctctctgtctctccatctaatgttgcatctgtgcactttagaagtacccgggagccttcaaaatatttggatgcctggacaccactccagataattcagtcagagtctctgaagacagggcccaggcatccctgtgtgaggccttcaggtaattccagcatacagcctgtattggaaagctctgtattgaggatgaggccctcatgctgcagagggggcctagagcacagggaagtaagttcctggaagcactagctgtttatcacatagggctaataaccaatggggacagtcgtgcatgcttctcttcttacatgctarcttactatgcttggaggcatacacatgtgtatggggagaggagggcagaatcggggagcattaggagaaaaacctaaagtaggcacaggaaagattccaggggctcacacatgaggcaggacaagaagaaatactttctcaggaaagggaaggggccgagtgttcaatgggcagagaggacagcagaagagaggagaccaggaagacaagatagcccccagcacttccacactaagccctggaaaggctatctgcagaggagccacctaagggtcttcccaagaccagggttaaagggaaaagcccctaaactcctcttccctcccaaatctgaggttgctcttgttcccttccaccaaaggatggcaccaagtagaatgacaaaggtgccatctccttcctctttctcagsgaagggtctctstcttaaggacaaagatgtgaaaggtctctctcttagggacaaaraggaaaggacagaccaacctacagagtggaggagtgctagaccaaatcctcccaatacatctatttgagtagcagagactggagacagtggttgaggtcaactatggggctgcactggtgctgatcatgcccgtgctcccatcccacacctggataaacagcagtgggcagcttcccccaccccccagtcttagaaaggcctcctccagttgcaacaggactccctcctccccatcgstgtcccagccacccagcggaaagytgagaccccaccccccaggtggccaattttagacccactaaaggcctttctgggctgtactgggggctaaagggggccaccatcccacagagaaggggccaaagacagccaggatcctaaaagtcagagctactttaagaataactttcccaggccaatccccagttcaggaacgttcctgtgccctgtgccagctagagggactagggctggagccggcggctgctcctgggtgtccagtccaggagccagtgaactcactatctctggagtttagcagaagaagggtaattccaggccggaacccctttctttcccgacctctcraccacagtcctccccaggcacattttagtggccagggatggagacccgcggataatgactgaaccaggtcacagggtgaaggttctgagatgtccggctcccgtagcttctgccagttcccgagggagctagcacaggcttggccttctttggtggcatctctgcctccacctgtccgtctccattccttgtgcccatagcacctcagctgctcggacacagaagttaaaaggtccggcatctgcacttgtccagagtgggttggggagcagagaaaggagtggtgagctgtggggaaaactggacatcctgacagacctgaaattcaccaagccgccagtggaagcctcaggttccgcctctataaaagggactcagccatgtgcaaggatgggtcgtcgcgaggattaaagggcagggtgaggggatgtcaagtgcaaggcaagtggtccaagcttccaggtggtccctgaccagttccgggcacatctttacccaaagggaggactcsgggacccccagccccgccgccgcagaccccctgtagcaaagcagggaactggacctcaaagggctgctggggaagacgggatctgaatagaggtctgaaggaaagaagccaggcgggggaccccgggagggccggacggggctgggggtgctgttgacactggagccggactggagacctgggaacytggggcagagtcggcagcggggagggggcgaccgaggtgggaaaacggggcggggccggagacgactccagggctgggtgaggcgctgacccccaggagctggggtgccgaggggcgcgggccacagcggtgcgagccagtcgggcgcccgcgcggtggggcgcgcggcgcggggattggcgggcgctccccggtgcccgcagctcttcagcgtagccgggaagagccgcgcgtctgcgcgccagcccccgccctgggcccgccgcccgagctctctggcgcagcgctagctccgccgcgctcagctgccctgcgccggcacccctggtcatgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccamcatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtyttcgtggtctacactttcctgctgggcttcctgctgcccgtgctggccattggyctgtgctacctgctcatcgtgggcaagatgcgcgccgtggccctgygcgmkggctggcagcagcgcaggcgctcggagaagaaaatcaccaggctggtgctgatggtcgtggtcgtctttgtgctctgctggatgcctttctacgtggtgcagctgctgaacctcktcgtgaccagccttgatgccaccgtcaaccacgtgtcccttatcctyagctatgccaayagctgcgccaacccyattctctatggyttcctctccgacaacttccgccgatycttccagcgggytctctgcctgcgctgctgcctcctggaaggtgctggargtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctgaggagccyttcccctacccaccctgygtggccacctcccaaggggtgggcaccattcctacagccccgaagactgcatctcctgaatgctcacctaagctccaccacctgttccttccagcagcccatgtacctgccggagagtgtcagaactcttctgctgctctcctctcccctgcactctggctttcaaaaggatgcttccatatgggtaggactccyctggaaactgggctaggatattaatcattcctgaacctctggctgttcttcaagggctgggaagcaggaggtggtgagaaatgaatggtccctgtgtgtgactccttacagccactgcttgggagaggactcaagaaggtggagggaggtagcacccttcctctctgcagacgctctgccttgtggtgggagcacagcttgtacaggagagaggaggaaggaagatgcccccaggcacctgccctttatgtctcttcctgrgctcttgttaagtgagacttatgttaacagcctggggcacttacttccctccccactcacccccggcctgggaataacatctgcttgctgtcacaggtgtctccctgagttgccctgagctgggagcagtcttcctgtgagtagaaaaggtttggagagacatgacatggggtttattgcaaggcataaaaccaggtcagtaataacaaagcagatgataaaaacttcatctagctcctatgatgtaattttttttccctgatcctttgatgtgggaacatgagaactcattaaggcagcaatttatactgtggtggtgagtgagagaggagccatgggcrggaaaagctgaccagagagcagcgagggatgggaaccagcccaggttttggatagaggaagcagcttcatcaccaccccctattttagaatgtcatctttcagtaaaacatcagccacattagatattaacatgtaagttgaacacaataaaaggccgtatctttgttgcctgatgtgttaaccaaaggataaattatctttcccaaagggaaagagcttaagaggagctctaattctgctttctgataaaagcaggggaggggacaaaggagaacttggaacacttatgttagcatctggtgtaacaacataggaacatgtatgaagtttgggggaccccacctggcttagcattcagagactacctctgggtttaaccggcctgattctggatgatcattctggtggtatggggaagatggtgtggggagggggagagacagccaaaggtcaacaccctatgcccttcagagtggtcagcctcacagaccactctgagagaatgggtagccatgtctgtactacatactggagacatgactgtggaatggaagttwcaaaactaagtcagagaaccctctgatcctgcaaacacacatgcacacacacagagacatcaaccatctctaatttgttggyacccaccagggataccttgggcatctgaagtcagtctccatgtctgtgggtctcgtgtaaccataactacttggagtttttwaaaactgcattatttctttgttcctcagtgtctgacaatgcctgccaggatgggcactgatgaatatggttgaacggaactccaaggaccacccaggttgatagtagtgaggtgaggggttcacagcactggcagtggtccccagggcttcttcccagcttgtacgtggggttgggggtcctttctttagtctctcagtgatcagactgggcaaactctctgakaagcaagacagggcayctaccaggagtcttggcaacactagtgtgtggctgcycagattagcatggaataagacacattctatttagaaatgtcagcctttttaacttagttgatgaaggttgaaggagaggcagcttcaggtgatggaaagaaaagtctctgagaggcaggacacctcagcctcagctaccccgtgagcagtgatttaacctctctaagcctcagtttcccacttggaatatgtgccaagggaggttcgagttttgagctcttcccagctgtaaactctgcattggcagagacaccgtggagacacgcgaatcaaatggtgggagggcaggagatagcacgcttctctgcttagtcctccttccatcaccactggaaaatgagcgtgaacactgcccttgaccctgcagtcataagtcatgcargtggtggcgggktgggggtgtagggtgagcctacccgctgctctcttcttyagcttcagggccttttcatttcccggcagcaacgaggtgcactgagcacttgtcggggctgtgtttggagcccatcaacwgtgctrccagctttagttccatcaaccccaggcttttgtaacaactggttgcatgaaaccctcccttgtagtttgtgtacagaagactgcaatgaattgaagycatgagacatacagccaggatcctgaaagccaccaacatatgtcacctgcctgggaggcttgcttcgatggtcatcttgttctgcctgctaagaccaggagtcacagctgttgacatcatggtgaataaaaacattttctgccacaggtagaaacagcctttgctcatccctccatctgtcagagatcttgctttttcttttacaattgtctttaatgtactgttccatggcaagccaggtgttccattttcccagatggtcagggaagatggtatttrgacatgacaggctgtcactcagcaggatacttgcccagtttgtcagctctgatctgtgagcaaagatgcatatgagtttcacactcatctgtgaagtattggcttcactttcattaaagtcatcatagctggcattccttagatgctagaggtggatgcaaaggatcaactaaatatagcacgttttggcrgcactgcctcagaaaccagacatgaatcctagcaaatgtgggcattgacactcttctctgagaggttggaggtagtgaattacccccatctcccacattctcattccataagtagatgacagcatagcctcagattccttaaggacaaatgttagaatcctagggctgtgttttctgagacagctccaccatggtgtacaccatcagccagcagcacaccctggaaactgtcttgctgactagcatgcatgggggtatacatgtggacagttcgctgagtgcttctctcgggtggtgcaacaggtttccagacaaaacgatgagtctacaaaggcagcttctgccttcatggagcttggaggttagtggcaaaagacaggcattaatcaaataagcacagaaatgagagtacagttctaaacctaaataagcactgtgcaggaaaggaatgtactttctaagagatgatgataaaagaagttgcccatgactcagagcaggctttccccaggaaagtggctggagatgacctcctctgaagcgtacctaggcattaactaggaaaggaaggggcggggcacaaggtgttcctgtaagctctaagcagagggaacagcatgtgcaaagagcttgcagtgggaggcactgaagggctcaatgtgaccaaaacacagaccacaggggcgtgtgaggcactggcaggcacatgagcaggagcctaatsccttctatgccacctcaaggatgagggctgtgtcctaagagccaggggtcagtggtggcaggctctaatgaggggcttgggtctgcctagtaagagaagcctatcaaaagctttggggtccttgtgaaattgaggcttaacatgcctctgcttttcagggaggggttggcaggatgatcatgtccttctttccaactttcatcaactttatatgaactgaaaggcagggacctcaatcctgtgaaggaagggactttagtgcctaacagtgggggcaccttctgaaatgggggagaacttatgtaaaaaaatgcctagaatgggagtattgactttctacaaagaaaaacatgtggcttcctattgtcaaaagacaccatgagcatccacctgccgtaacatagcacttgaaatgactggatttctggggctctgcctaaagagtggggctgccaaaggtcagcactcacccagtgtgaacgtgtcgtagatggggagaaagaacaaattgagaggcacacaaaccaggactgagttccggctctcccacttccagcccacagyggcccagggaaggctgcatgactgtgtggagagggcagagcaacagtatccacctgcaggtgcacagtgacacacaaaggccatgttcctggcccaggggaggaaggtttaccaytcaaatggtgactacttcatgatatagaaggaggaagagggagttggtacacagttgggtgtcttttttttccatttttttttttaatcaggctttcattagtgttctgaagaggctgtaatttctttttaatctatttttaattggagtataatttacatatggtagagtgttctctttytagttgtacagttctatgaattttgacatgcaaatttttacattttacattttacaattttacattttacattggggcaactaactgttgccccaatcaagatcgggactgttttggtcaccatctacttccctcttagtggctgtgatttgtggccaaggaggaaggacacagacagcatggggaggacctgaggaggtacagaattggagatggtgctatccccaaatccatggaggccacctggttataccatttcccgagttcatccccccagactaggagacctcaaccaatttacataggaagctatagccctcttgaccttatggatctgaaaagaagtatcctggaatctagacaccacctggagaaactagagggttgagtatgtccctgggcaagctgctaattccataatgacttcgtgatcctttactccaagcactggagagagggtgtggattccactccaagctcccttccgccaaacagagcagagtgctcctcaagatccagccgcatcccaaaagcaccatttccgtttgtcacgggcctccaggcagcttgctgttgagtttgctcrtgtttatcatggccgtatcctgtgctgtggagagtcatagacaaattaaacagtgaaactgggacttgccccatgcccttttcagactttccattctcctggcactacccttgggtttctgcatgctacctttttggaggagggggaaaatacatgaagaaagactggagtcaaaccctggcaaaggctcgctgaaaatggggatttgggattayatgagcatttcagaacagatttattaaaagagggggacaatgaacaaggcgtaggatctccaaagagtctgtggaaggtgggatccatgttcccaaaggatttaaatcgaaacaaggcagkaggcagtgggaaaaggggaggaattagggagaatgtggaaaagcccctctcctctttgccaagtagaacaaagctttgctggacaacagcggggtaacttagcatttaggtacggcattagcaagaagtcagaaagaagatttgagatgggcacagaggtgctaacctctaaccaaaagcacagaggttatattgccaggcgttgaatatgcagaagataagtgggttttgtcttaggataatatcggtattaaaatggctattttaagagaagatttccttcaggcagagatccaaggaaatatctggcctgtggcccaggtggcataattgtcacagaccccagctttgactcttggtgtttctcattggatccctgaaaccctctgctctctgctccccctctccagtgggcgtaaccttgagttaacccatccccagggttcttttgtctttcacaatcacactttcaaaacaccctgaaaaggatttcgattctattagcatctgatgttaaaacaatatttagcttcccttgtgagaagaaatcagttgtttgcctacatctgaacctgctaaccaaaaaaaaaaaaaatgaggaagggaacactcaaaacaaaaagagatatcactgaacccagggcattcattctggaaaagaaagaaagaaagaactgggcattgtctgcattgttttatgaagaaatgcttctaaagctcaggagatgtattttgggtacccccactcagctataaccatgaagaaaatgtgttttcatgtattatttgcaacctcagttttccttgaatagatgatataataaggaatcgcattcaacagagaatagcaagtgactccagaaggtaggaggtgggggatcttctgtcccctggccccatccacaaccataatgtctctcaaaggaatgtcacctacaggaacttccctccgtacctcctgctggctctgttggggccagagctatgtttctctttctcctctgggccctgagaaatggagaagggcactctggagcatgttcttcctcctccgagcctccttgggagaacagcggagggagtctctgtcccctgtacttgactaagccttgtgagaagggaaaataagctgaagccttcgaagctggattttagagtgaccgagtgttggagctcacttctcacctggcacaaaaatcttcctgtttaagctatgatrtagatgcctgcaaatccaacattacagttcctctagcattgacaacattgctccaagcaactgcatcttcccttgatggaacagtatccactttgtgcaaccttgagtttgcccgtaagacactcatgattccaacacagcttttttctgtactcatttatgcatctaccagttcactggcacacaagtaaacagttattgggtatctaccatgggccagaaactgagcttatctaatcttcctggaaaccttgtgaggcggcactgcttgaacccgtcttacagcctttgaagggtcatgtggtgcccgtggccatgtgaccagcaggtktcaggctggggtcacacccaggtgtgtatgctgttcacaccacataycagccctgcggggtgcttacagcggaaattgtgcaggttcctgcccaagagggacatgtaaatacatctaraagtagttgttatcttcccaaacaatgcagtacataaattgaatcccagtgcactctcatcaaaactccttgagtgcccccacttgcacccagaacatttttcaatgtcactctttcagtctttttttcagtgtctttgacctacagcccctacagtcatctcccactgcttgtatctctctttccacctcttcagctgcsttgcagcccacctcaccttgttcactatgcccagtccgctccaccagggctcttcccagtacagggcctttgcargtgtgatcyttcccacmtggactgcttcccctccagtttgcatttgacaaacccctccttccccttcargtctggtgttaagtgtcagcttgtccaggaagctccctctagtcctccactctaaatcctgccttcctcgtgcgccttttcagagtgtgctgtgcttttcttcccctgcacttatcactgtttctaagttaagtacaatttgggggtgatcagttgttttgcatctttctcccctgccagagtctaacttatatggtagggacttgtcattgtgcctatcactatgaaaggcacagagtaaatgctcagtaaataattgctgaactaatctaagaaataggtgagaactggaaaaaaaaaataacaaagtcatttgacttaaaaaaatgcattctgtttactttaaaacagcaggctaggaaaaacaaacaaacaaacaaacaaacaaacttgaatgctggcttatccagaaataccaccttggctttcttgccccggacttttgtgctatgaaatttcaccagcaactggtccctgggagtctccctcagacctggatgtccaatgatgtgaacagaaagcagagatcacacaggttgacccatggctctggtttcacaaggtctatcctgattttaaatkctcagggatagtttttaaagctaactgatttgtttatgtggtcctggtatctttccctgagaggcactatggctatttagcgttttgagaatctcaagttcagatgagacctataaacagaactgctgatcccccaggcagcaggaagtgaggaggacagggaagctcagggccccgcacaactaatgtcctggggcccaagtgctgcatgaagggtttttscctctaggttttgaaagtgtgttttggtcttccagtgttccttaagaaaatgcccctcttctggaataagaagaaatcctaacgcaatgaggccctacaagtcagtttgacagtgactgggagcagactctttkgacaaacagaaggctrggtaacagggggcgaactataaggtgtcactgtctcctctggtctcccagccccatttakctgcacctgtcctgcccccatttgtgtagctcttcyttcacaaagacttagtctgctacttagggggagcatggctcagcttgttatctccatagggcactgtgcayggagcttccccagcacacacacacacacactaaagccattacttcttctgcgatggatgtcaaaatctccaacccggtcttcacaataatcagtcaaactaaaactcatgagttcagcattatccagacatataaagcatctgaatatttgcctggactctacttgyttttaatttcttctttaaaaaatctttccgagccctgcatattgcattcagccagccctaccaccttagaaaagtgagcccaagaaacgtgtgcattgaaaagatsatgttgttaatctccaaaagagatgagaatgatttcatactggatgagacgtttagaaatgaatatttgaatgagagccacaaactgagacccttcatgactacagtgaatttggatatctcgcagaggagataatgccaaaccatacaccggacacacagctrggattcgccagatgccccaggaagggtttatttaattcattccaacaaatgatcctataatgcatttatgcatttaaaagcacagagacacaagtcytcatatatgaagttgttatggttacagaaagaaaataaatatttgtgcacacrgagatagcatgaaatcattctacagtgaaaataatagcctctggaaaaagctttgaaaatcagagatggtgccaycaccagacaacacaagtgctggggtacagggcagccctccatgcatctcatagcatttgcatggtttgtgagccccatttaatgacataaaatgagggcactgagggaggaaaagtgaacagacacacaacccgagawcacattgttatttgttkattttgtacaagtgatgtcataagcaaggattttgcctgtgttctagattatctccaataaataaataactatgtacaaatattttgagtttacaaaatagaagaggaaaacctttgtcttacaaaagttacatttctatgatacatttatttccatacactgaagcaggatttcattcctagcttagctgaaccaaagaccttgcagaccctgtgtggcagtgtctagagctgtgtacctagccttttctaccaaagagcaaagctacacaaagaaaattcctcagtttcttraaaataagggcctgacttggcctgctacttataactgatctatatttcatgtattccagaaaattggaagcagtctggaatggttgtcctcaaattastgagcagacacaccccctgcagatcttgttaaatatagattctcatgaactggatggggtggagcctaggattctgcatttctaaccagctcccatgggcagggcagcttccaattcttgttcaggggccacattccaaaaggcctctctgaaatggtagaaattctctgaggacctgattaaggctaggccctaattgggcatcctccaggatccattcccaagctcccaattccacaagaccagtagagctggttttattttggtctaccagtgacaaggaacagtgacagtcaattgctaattggcatgaatcatgcagtttgaagctttcttgaactgtctcctgggaggtgtttgtctcttctckcaatctagagcaaccttctgaacattttcaacactgtcaaaaataagtaataataacaaaaaaggaaattgcataagaagattagcaacaattaccatttttcagtacaaatcaaaacagcaacaaaattcaggctcactgtttaaaagtaaagataaatacctctttgggtgtaatttctatgacagtccagcaacatcaatttaayaccttttacatctcaacctttgtttaaaattattttgctctgggaatctgaaatttcaggataaattagcaaatctggtgaaaaagcaaatggccatttttatttttagtgtttttgtttctgtttcatgtaggggttctgtctgagcagacagctaagagcaaaagaagtagggtcaggcacaggtagggtgactcaggtgagttggcccagttcctgggaggagaaaactaggaagaatggggaataagtggggcttgcttcataaatgtgagagggctaggaaaaaaaaattyaccaagatagtttacctgtcacatgacaagtgggagtttgtagagagagagagaccggagagctgtgcaaagtggatactggagacatacaggtaagaacaaaggaaacaaacaaaaacctaaatacttaaaaaaaataaatattytagtcatccctagcccacgaggtcaaggtctgcccagaaggctgccgaccaataacgctcaccctcctgcgccyggtagtgaggacctgggacaaatcgcagtctgtgtcttcgttacaaaattgccatcattgcccagtggtccagtgacgtcacggaagaggccgaggctcattctcctccctctaatcaycccctcgccagttagccatggaatagaagaaaacagcttggggggtgcggggagggtcttctccagctgtmatgccagctaaggtgctttggtagcaaagctgggggtgaggaggcacaggctcctggacgragccaggctcctggayggaggccgctcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgrgcgtcgggctgggcggggrctcgccagagccgctgtcgccaccgtmcaccttgccggagtcacagtcggtgccaatgtggcggrcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacytgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggscttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgscgtcgccgttcagtagcaaggaaatgacatcggcagccaccgaggagcgcactgtcattaggtggccccgcagtccgtcgcagatctgactggcattgaggaaggtcgyggggcccgggtagagcgcgaagcagtcgtgctcgacgcactggctgccacccggctgcggctctgcgggtgcggggaaccccaggcyggccagggccagcgcgccaaggaccaggaccccaagcatgttacccaggcgcgccgcgtgcaggcrccggggaaagcgcgggcactgcgacagggcsgtgccggagcagaggggcacaggacgccgatggcgacagcctctcctgtccgtcccagcccagacacttcttgccgctgcgcgcagcccctgcgaggcagcctctgacatgcggatcggccagggctcgagtttataagtgccyggccctccctccctggacgttcgggaaaaggaaggaagtgcctggtgggaagggctgatgccgcatactcggattgctgggttctctggccgcccttgcgcccgccctcgcgcatgggatcacctcgccgggatgagtaaaccctgccctggcgcagggaggttctcgggcggggccgacaggggcaggcgccagggaaggccagcacccctgtaacaagacgactgtccccgcccaccactcgggcccccacgcgtgcagccctctttcatctcttggtcctcctttctttcttttcatacatgttacagccacttccaaggaaagcctggattgcaagagctctgggaaccggagacttcagagaagagggctttgaatggggagtgggggaggtggtgcacargacctgcaagacgctgggaggggtgatcggcaccaagggcactttgggaggacctgcctaggacgtggacttccccgaagacaggatcgcaaggagagacagctggatcctgtccgcggccaaggtgcctggytcaggaaaccagcggagcgcgcttggcctcacaggacagtgggtgtggctggggtgacggggcagggtggggaagactggcctaacaccagcgccctctgccccatggctggccagggacccgcgagtccctggacacgcactggccaacgccagaccccatctcatcgggtggggaagtcgcggggacactgtcagggcgccgaagtccggacccggctmagaggcsgtggcaggtgaattgctgcggcgccgggtaggggcgggcgcgtgggagcgagtcagcctggccagtttcggcccagcttccgaaggatggtgcttcttgcaccccaacagagtggctggcaaccccccaggggagcgcgcaggatcccagctgatcccacccgggtcggctaaggaggtttccatttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctactgtcctcacaacgagcgccagggggcggcgctgtcgagctctaaacaaagccaaggaagttggagaagtttcgggctaaaaagggttaaggtgtaggagcacagagtcytccttctggggttggaagctccgttcccgggcagctcagcgtggattccgctgcgttcacctcttgcctccagggcccagtagatcctgggctttaaacaagaayagagagtatggcgtctgccacgtgcgacagacacrcaccggtggggtgggccgggctggactggactgacctgcagtgaccaaacgggtggggcgtggacactctgaaagtgaaaaaggcaagcacgactgtcccgccgcacactccccagcgccttggggcagagagcctccaaacgtcccgctgagttgagctcttcgctgggaaggccgccccagcacccaggaaacgaaggagctgctggacacgggggtctgaagctcccggaatgcacacagctgcgcctcccctgacgcggascccctgggaagaggaagggaagagcggcagatagcacagtagggcttgtccggcgggagcagtcaagctgtggctgcctaggctgaatcagggggtcgtgactccggtgcacagcctgcctacgcgggacgcaaaagcagggctgcctgcggtgccgccatgggggtgagggtggagcttcagataagggcaggaacctcgttggggcactgctgaaaggtctcagaatgtggggacaattcccagagtgaatgagacaagagagggggacaggatyggttacagaatcagaaaccagtgcaaagtgaaaatgtggggtccattgttcaattacaaggattcaagactgtgatagcaaagtgttaaacaaggaatgaggccctgggggggtgatgagagggcccttctgaacctgccagccctaaaagccactgagggacattcaaggatcagatctcaccccacaccaggctggctgagttcttggatggattctagctgattcaccaacacaatgtttcactggacgtcctacacaggtccacttgcacccattgctgattcttgcaaagaaaaaaaaagtgtgagaacagccccaatagctgagtccactaagaactcagtgatgtctgtgaaacttggatcaaccctatatgaggaggtgcagatgttggatgtttctgtattagaaagaaactagagcaacaacagatagaagcagagcattgtcccatggggggtaccacagtgtctgggttgccctacacaaggatgggtggacatgacccacttggctttcccacctgtaagggctttacccmtgrccctcaggatacctttgcyttgtggggcctgccctcagccgctttgtttttcytctccagccaataccttggaggctttgcatattttagactaccttctggtgactgaaggtcccctgtctgtgttcttgccccatccctatcttcctatctgtgccccctgcacaccagggtgggccactccttcctatccctttgcagataacacatccacttcccaatgcttggcccagttcctggcccagcrccctcactctggcccaccagcagacttgctttactcctgaaacagctcccttgaagaacacccatctggtcctaaatactgttgccaaaatcttgttttcagccatccttctagaagccttggtgccatttgcacttgtgacccttcaccattctcaaggctcctcctccaattacttttgagacacatgttttcctcccttcctctcctgtgagccttggggaggcccctgggatcctcttgtascacccactagagtggccattctcaaggttttgctggtggtcttcatcatctctttacaacccaccttttggtgaacttacccattcccctggcagtgatagcagtgtccaaggagattggggagggagtattctagaagggacccttaccccatctttcccagtatcaatagttggtccactgaggttttaaaccatgcacttgcctttgactttctgctctccttcatccactgcctagtttttgtgtcttgtttcccctgatcactgctcctgccttctcaatttatgctgagacagttgggtccccagctcttttccttgctgcttatctctccagctctccaccgtggctgaggctactctgatcctcatactccctcagtgctgctcccacccgctgggagagcccatactctttcccctccgcactgaagatgctcgcgatagtgcctctactctgtggccacagatgagaaaatttgcactcaaggggctatgctggaatttggacccagagcctgcaccccttgcacctcacaaggcttcaaggaccagtgttctgctggtctccatgaatgaggaaacatcctggcaagggaggctcctgctcactgtcagagaagcaccttgtcygctcatctccaccctgtagttcatgtctctccctctgctagcaacattctcgtctgccaggctcttcacccactgaaatctttccattctttcaagtcccagttcaagcttccccatcagcaagttttctgaataacccaaccagaactgatctgtctgtgattcccatagacaggtcgttctctcagctctttagtactcaccactccctccctgccctgtacctaatcatgcatataccacactttttgctgcacttakactccagattcccacacatttttgtatccccttacacctaacagcacgctttgtaactagacagtgcccagagcttattggagcacctgtggtagatgtttctttgtcctctccagggtgattttctcacattcacctgcaaagacaaggatgggggacctcagagcctcagggtgaattaagagtgtggactttggagccgacttggctgcactggagacccagctccggcattcacaagtttttgtttattgttaagatttgactaataacccctccccrtgtagctcagtttccttgactgtgtaatgggaatagtcccwccttcaaagtgttaggatgaagattaaatgggttatacatgtaaagcatttagaacagaggagccgtagtcagctctcaataaattttagcaaaaaagaaaacactcaagtccctagaatttggattcggcatctgattgtattcaatatccagcatggtttcttttccatggtagggactcaccaaatgtctgttggatttaatttgttccagccaagcatttctaccactaataacaataagcaattgtgaaaaaaaatcagggatggaggcatagggaagaaattgaagcatgtcctgtcttaggcttcccatctgccctagagacatccatagtgactgtccccattgcccaggtgtggaagctgaaggccagagagaatcagtgactctccaatgtcacacagctagtaagtggtgaaacaaagattcaccggcctgtggtaaggatgaaagaattacaatgtggagtatgtctgagcccccattttgccacatactggcckacttggctaagttatttcaatctctggtgttctttcccaaaaactggagatataatatctaatatgtaggattagtgtaaaataaaactctttcccaaaaactggagatataatatctaatatgtaggattagtgtaaaataaaacagaaaatgtacatacagtgactattacttttcttggaagacagcagctgtttaacaaatatggttgttattrctgctatatataaaaaaaaaagctttatcaaagacccctgtggtcactggtagccatccagsaagtcttgctttttayttatttattgactgattgattgacttttgagacagagtctcaaaatcggtagcccagactagagtgcagcagtgttatcatggctcactgcagccttgacctcccagatcaagtgatccgcctatctcagcctccagagtagctgggactacaggtatgtgccatcacacccagctsatttttttcttttgtgtgtgtgtgcagaaatggggtctcactatgttgtccaggctagtctggaactcctgggctcagacaatcctccacctcagcctccaaaastgctgagatcacatgcatgagccactatgcccagccaagcccagctttttagatgggagtttctgcttgatgtctgtggaggaggctggaccaactacctgggcagtgaacagacttcagccatttttattgaaagcaaacatgtgtgaatgttgttagaacacagatgaaaaggagtccacagacagaagggggccccagtggcattgtgctgaccccatacataccttagccatatttataatacactaacaatactaaaatgcacacataaaaattaagtctctatggctatgagcaatatataaattcaaggatggaaaaataactgtctgttaagcaaatgttatctaataactgcagcacrttagagcaaaacaagtattttccaaaattttgcctcttactcaggctttcttaaagaaacagggtaaaagtggacaattgtttgttggtctattctttagaatagactttattggtctattatttgtaaaagaaaatatgtcgcatatccaaaaaaccataccactaatatcatactcaatggtgaaacactgaaagcctcctccctaaggtcaggaacaaaacaaaaatgtcttctcttaccacttccatttaacattatgctggtgatttcagagcagttagttatgaaaaggaaatttaaaagtccaggctggaaaggaacaaataaaactacatctatttgtggatgatattaaccttttttgtatatggaaaatcctaaggaaaacacttttttaaaaaactaagaactaataaaggagttcagcagttgcaggatataagatcaatacataaaaaacaattgtatttctgtataacaataaaaaaatgaaaattatgaaaacaattccatttataatagcatcaaaaagaataacatacttgaggataaatttaacaaaagaaatgcaaaacatttgctcttaaaactacaaaacrttgctgaaagaaactttaaaaggcttaaataaatggaaagacaccctacgttcatggattggaagacttaatatgattaaggtggaaatwtccccacaatttatctacaaattagatgcaatctctatcaaaatctccgcttttttctttgcagaaatttacatattgatcctagcattcacatggaagttcaagggattccaaagarccaaagaaatcttggaaaagaaaaaaatatgaacacttacttcctgatttcaaaacttaccgcaaagcaccagaaccaaaacaatatagtgctgggataaagacagacacgaatcaatggaatagaattgagaatctaaaaataaccctcacatttgtggtcaattgatttccacaagggtgccaaggcaattgaaagaatagtctcttccacaaatgattctggaacaactgcatatctacatgtggtagggtgggacctctacctcacatcaaataaaaarttaaagaaaaatggtcaaaacacttaaatgtaagattaaaactagaaaatcyttagaagaaaatataggtgtaaatctttgtggccttcaataaggcactggtttcttaaatatggtacaaaaaacacaagcaatccaagaaaatgtagataagttagacattatcaaaatttaaaacttttatgcttcaaaaaaaaaaggtggagacaagccacagaatggragaatggtaggagacatttacaaattatgtacctgataaggtctctctagaatatataaggaactacaagtcaataattaaagacaacaaacccaattaaaatgtgggcaaaagatctggatagatatttctcaaaagaaggtatataaatggccaatatatcaggacacctgagtgagaagacagatcctgtgcacatggaaagatgctcaacatcattagccattaggggaatgaaaattaaaaccacaatgagataccaatacacacccactaggatggctacaatcaaaagacagagaagaatcctcagatagtgctgatggagatgtttactggtgcaaccactttagaaagcagtttggcagttccccaaaatgctaaacaacagttaccatgtgatctagtaattctacttctaggtatatacactcaagaaaaattaaaacatatttgcacacaaaagtttctatacaaatgttcgtaataggattattcttttttttttttttgagatggagtctcgctctgtcaccaggctggagtgcagtggtgctgcaatcttggcttattgcaacctctgcctcccaggttcaagcagttctcctgcctcagcctcccaagaggctgggactataagtacacgccaccacacccagctaatttttgtatttttagtagagacggggtttcaccatgttggccaggatgatctcaatctcttggcctcataatctgcccaccttggccccccaaagtgctgggattayaggygtgagccactgcgcccagccccagtagcattattcttcacagccaaagagtagaaagaacccaaatatccatcagctgttgaatgaatgaatggaatgtggcatgtcctgtccatataatgaaatgctatttggcaataaaaagacatgaagtactgattcatgcacaatcttgcaaacattatgctaaatgaaataagccagtcccaaaagtccacatattatatgattccatttccatgaaatgtccagaattaacaaatctagagagacgaagagtccattagtggttgcctagggattgagagtaagggggaattaggaaaagactactaatgattgcagggtttctttctggggtgattaaaatgttctagaattaatttgcaaaactctatgcgtatgccaaaagccattgaattatacattttagataggyaaactgtatgatgtgtggattatatctcagtatagctgtttttaagaagaagaacatatgttcccccagtgaatgaagcatgagagyttaagtgatgaactgccagtggacctctgagccttttcctgcagccgggggcttattgtatgaggaaggatagaatacctatagctgtctaccttgacacagaactttggatctatcatctattggatttccatggagccaaaggaagctygggaatgcccagtgatctattcagggtcagtcatccagggtggcytactttgagagcaaagagaattttgtgtctagcagattcatgggacactaccttggtcttctcactcaggtgtcctgatatatcccctcctctcaagaggtgttttctgagaaaagtggaggaccacagaaaatagcaagagagccccagaggctgcctgctgggcaatgtctctttctgraacatgtatctggctggacctggtaatctctgctcaggccaataggtggtgagcaagagatgaacaggcatttgggccatgggtcctctggcagttggttgaagcccacggacccctttctagaataatattttaaataaatgtatcaaataaaactcacagaattacaaaggaatccagtcatattgaaatgaaatattaaaatctcaaaaagtagcaaatatgtgatatcaaatataagtgcttcttttgggatattttaaaacacaagttctcatggtgcgccacctaaatgccataatttcaaagtggtgatcaatgtaaacaatattttgagagatctgtgacaactgtaatgtggtctgtgtctgtgatttacagcgatgacagtctctggtcctgctaacactgctctcggtatttaccttgccttttcttttctttccttttggaaggaraggatatgctgtttcargtgcagattagtgaaaatatrgaagtaatgttttctccattcaagctgatgagacccctgaatgaagaactattcacttaaaagaacacagaactatttcggtcagttcaagtagaagcctctagaatgttattgtgtcaaggtgcgttttgccatgttagactctccctttattttctacaaaatatttgttcatagcagattatatttttattgaaaacaatgcatatttgaaagaaatgctcttacactcagaaacactgtccttggaagacaaagtcctcacaaggaagccaagaaatccacaagtgttgtttgagaaacgtcaactgtgcttcggctgttggcacacatctcctgtgggataagttcargccttaaatgtatgcaggacaagaggcttaaaagtgagcatgtgcagagaacaaaacctatttargcaggaaaataagataattggaactatatattttaatgctattttacagaagtatattataatatattctttaaatgcatgaaatgtgagaaattgaacaatgaaaatatmtatcactaatataactgcaaatatttagtgcttgcctttaattttttgtgaaaattagagatctgaacattttgttagcacagtaagtatatttaatatacctattatcaaattataactgatagatccagtggatggaaagctatggaagtaaacacacctaatatagaaagaaatactacttatggtataggagatatatatatataattgttacagtaggtagctagtcaggcctgagcatggcaggagagggctcctccaccaccagsaatgtcagrcaaccatcagatgatggtcaggcagttgttaactgtctttctaaaataatttgttgcagccagtgccagggaaagcagtctysctatcaatagaagaaacctcaaactggggatcagcagcttccagataagatctcaggagctgggtaagtgggctcaagcttgtgcattaagatgcaaaatgacagagtttaattggtatatgaccttctagggacatttgactggcaagggaagaatgcttgaagtgagcatgtgtacaactccagtaaacaaactgwgctggyaggccactgagcatgtggacagcccatcccaagggaagaatcaggggagaaaggatgcaagaccccagaagtatgccaacacataaaaccccaagtgaaaaagtcaaaccacgcacttgtatttcaagttggccacttggccctcttccaagtgtactttccttccttcttccctgctctaaagctttgtaataaactttcaatcccgctcgaaagcttgctagtctctccttctgcctctcagctgaattctttcttctgaggaggcaagaatggaggttgctgcagacccatatggatttgctgctggtaacatcattatctctgagttgaagcagcatgatttttactttcttctctttcttatattttctacatgcatttattttataagttaaaggctccactccttcattaaaaaaaggtaaaattattttttgataattgaaaattagtcagttcaaagtaatgtggctggtaatacacatcgcatttttgcagtctcttgcaaaacagaagctattctgactcccttgtagctcactaattttcaagaatttaataaaaatctgctgcctgaaagagccgctcctgtcatcttgagaaggctggggtctttgcaccccctgagttcagtgattgcttccccaaaaacacatttcacaagaggatagactttatcacatgggttcagccgggctgtgtcatagagacccatcccaactcaccccrtgttattaccagtgaactactgagatgctaaatctttggcttcttggtttgagttgtggaaggacagataaacaaaagtgcctgctaagacccagatatctggaggaattctgtggatgccctagagcaaggttgacgtgcygtgtctgtcaagggcaagagagtaaacatttcagctgcaggcctttcagcctctgtcataaccactgaactctgcctttgttgtgtgaaagcagcaagcctggtggagccccacaaaatcggttatctactgccagtagcaaacctccccaaaasttagtgatgagagcaatgaatattgaaaccctggttatctgaccaagtcagtattggacaaatttgcacagagatcttttggtgatttgcagaagctggtgcaggcagacttcttattttcatcaatatctagctccatcaggactgaaaactgcagactagctactctagacttctggtggctgagaacaagcctgcaggatggcttgacagctctgggtaaactgtctgagaacatcttcagcttgggcagaacagccttccaggaatgaagatgtcacagagagcagggtgctggagagggctttactctgaagtaggggcggccaatatttgatcccatcattcagaaatccctcttctacccacaggcytggcagtgactgaggctccatctagctctgggagaagaggaagggagtggcttcccactgggggtgcytcagacctcgcttacctccacccatagctggtccacccaccatgggtgctcaaaagtagaaggaaggatggggaaacattcagtccacgtccaaatcatcgagaagacttttcagattgggaataattcygaagccagatcccagcaaggcactgccaaaaaatggctctctggggtttattttcctttggaaaggacttttgggacatacggcaagagggagctttctgggtcccttaaagggccctgcaggaaagaagggcagtgggacgcattgtctgttctccatagacaatagggcagactgcttcctccttgggactggtagttacgtttatgtttctgacaaccagctggcyactgaagaagcgtggagccaacagctgcaagggataattttggcagcatcacccacggtgcaaatttaaaactccagctggttctactgcaagcagaataaacacaaacagctgataataagtaaattcagaacttgaaatatgccagagacactttatagccctctgttttctcctagtgtgcactctttgtgctctcatcctgtggtcttgagcgtgaacatcattttcatattttatcttgctatctaaaagttttatttatttgggaaataagtaggctctgaatctggggggaaaatagttgtcaagaaccaaatatttggcttcctgtttcccagaaagtgtttgctgctgtttccatttctggcccaacatttttccagagttgaaaatgtcatttaaatgagtcagtccccggggctcagaagcaatgataaagatgtggacatggccccagaacgttggagcactgctgcctctggtggactgaagggcagctggcattaaaaacaggatgttcctgctgtgatacaggcagaggaagaagaagggtatgcaaaccaaggcagtcccctgcagccttgcccctcagtgtgtggtcccagaccagcagcatcactgcacctggtagcttgttagaaatgcacaacctctgaccccaccccgacctcctgcatcagaatctgcctgttgacaaggtcttggggaaaagggtattggggaatttgctgcacacacactccgctgggcaacccaacggcctcaatgagaccagcctgcacaggattctacctgccttcccctaccttccaccacagtttcaatgatcctcttaggagtatgaaaaaggagtggccaagattgtcagcatcagcttttatcttctctctgtgaacacatatatcacttaccaacttgtcagaaaggcagattcctgggccctaattcaaacttcctgaatcagaaactctggggattgggcccagccctgtgggttttagcaagctctccagggcattctgatgcacaggtttgagaaacaactggctcattgtatgtgaggcatgaatgaagtggcctccsaggctctgctcacatcctcactacccycatctcttcctcctgggctttccaccttgggtcctggctctaccaactcttccttggatcctgaatctacagtttctacctgcatgggcacargtatcacaaaccttatcctgatgggatagtggaactccaccttcaagccaagataaatgtaatttgtaaaatttttgcacagacaggaggtgcagaggacattgttatcatgaagctgaaagtcatgcaataggatggaaaggaggaagactgaaggaatccaagatgctaaaagtattaagaattcatagcccaacctcatactgttgggctatgagtatgtcaacctcatactgttttctgcaaagaaacagagataataagtgctttaggttttgcaggccacttggtctgtgctgctgtaacaggagaccagccgcagaccatatataaacgaatggatgtggctgtggtccaataaaactttgtttacagactttgaaattttcataattttacatgccrtgaaatatttttcttcttttgatttttttctgaccattaaaaaaatgcaaaaaagccatttttagctcacgmaccatacagaaacaggcagtgggccagagtgggcctgcaggccatagttttccaaaccctgccctacaaacattaataaagaaaaaaacttagaagatgcaggacttgcttatgaaaacttcctctacttcaaaaaagatatatatagagaagaaaaaaacccaaccactaagaagcattgtattcaaatgcaagagacaatggtgggaaragccctctttgtcttgtttctgtccattgtggatgtttcttgtcactgttgtggaattatggtgagtgaaagagagggcgttaagaaggaagagaagagaaaggaaaagcaaaatacagtgagtatttakgaagttgtagaaggcaaagtaaggactgaaatgaccacaagcttcatattacaaggagagagaaaaatgtggttctgttctttcagttaaagagaaaaacgcttccaccttactccccaatagaaccacagatctcagagttggcttggctgagaccaggcctattggattcttggcttccggtatcatgcagcttctggtaagtcaatgtgtttgacattcctccacactctagactccccagctcccaaggaaggaacaccacctttcatcttccaggtcatttcattctgctatgaaggtgtttccatctcaaaaattggtagttcatataaagcgggcaaatgggcgccatagtcaccacyttacagacactgcactcatttacacaccattttgcatacatttgttctgactgctcttcagtgagaacttcattacttttatattacagaattgttatacttttaaaaaactttaaatatcrgtcatttgtagtgagcagcttagtattttccgtgatggagtgtaatagttttccattgctgctgtggttaaaaacaacacaaacgtatcatcttagagctctggaggtaagaagtccaaaattggggcaccatcagggctgctctccttctggagaatataggggaggatcctttccttatctgttccagagatcacctttatttcttgacctgaggctcctagctccatcttcaaagccaagagcatacacagcatcttctcacctctctctctgacctctgcttctgtgtcacatctctaacccttctgccttgatattccatcttttaaggaccctgtgattgcattgggccaaccaggctgagtcatagaggcaaaagccaataaaggattaataacaaaaccaaagggaaaaaaatcctttgacagaattgccctagcatgtctggtttagcacgtgagcaaatacagcatttgggctgcgtcttatgaaatcttaatggcttgtgaatgaaatgagttaaaactatcaaccatctctcgctgaactgagcttagtgttcccacttaagaaattcatttctgaattttattaaatttttaaaatctcactaaaactatagtcctgtctgctgatttctagggtagatggccctgatgatgtaataaatcctcttcatcaagaatgtcttggtcatttgtatttctggcactgtagtcctcacagtagagcatcggtcctttgtcatctaaacaaaactcacttggatttagcagcaagaactttaaggactctgattgtcggggctgtgatcctaagcttgaaaggatcagtttattagcaatatctcacactctttttttttttttcatgttgagcagtagaatataagagatgataatgaggaaatggaaattaaagacgtgtgcgtgtgccactccctgcagattcggtttataccatgsctccaggagtcacagagcgttggacacagcaggatgrgtggtctgatcccagctatttgcagcccacacagtgatcagggrattctttattggtcacttttttttctttctctctaccaattaatgttccttgttcttgatccacccctttgagccaaacaaccattgaaaagatggaaacatcattttccatgaaagtacacatcttgaaccctgttataacctgaaacagaaaatgtaaaaagctgctgtcagttcctccttcagtttcagagtgcacacaaagccctactgtcaaacttaaacaatgtttatagtgaaaagaaatgattagaagcaggaaggcaccacagggagtaacaatccttcatgtttggagggattttatttgctttagcaatctgatggaaggaaaagaaaattcccattatcaggaacatcgcccatcggagtgcctagtaataaaagtgtcagcaccaataatgttattaaaagaaaacactttctaggttctgccacctacgtgttgtatscctttaaaaggaagcacagtggatagcacagtgcctgtagaggctgagctggacgtggatttgtttgccttgaagctttgtatcaacagtatgggcacctcagctctgaattttctgataaaatgaggtgtgcacgtagagttcatggcaatagtgaccttcagactcattcttcttcagatccttctttttagctagatctacaatggcattccttttcccaggaatgcgattcccaggctggccaaactcatgttgccatgtattamcccccaaggcaaatagcaaagtttcctttgaagacaataaatacatagtccatgggctggacaactggaggtgttttggaaagttctttttattttcagcaagatatggagactcactttccttggatgagtataaaacatgaaagcagttattctgtagatgtctaatggaaagctctagaatctctaccacatttcttggtgccagcatttgcattttttggctatttattggaacttggttgcatgtcattttttgttcatccatgccattttctgactatttactttgtgctaggtgccatattaaggacattaagcacattacatggaatcctcacaacaaattatttttattatccctattttactgaagatgaaattaatttaggaacagtagcctggccaaggtcatggggcagcagtgaagccagaattcaactgcagggctgtgtaactctgacatccagcatgtaaccacatctcaatccctgaaatgatttaagcaaaaggaagcaaatgagaagaaatgtgtgctctttatagttttatgcatcatgtgtgggtttgcctctgagatgtgtcaaggccctgttgaaacagtcttgtgagatgttgcttccgaaagacgtagaagcacagctgtgtgttgataatagtcccaaactggtaacacttgggtgttcatcagcaggtaaattgatacacaattgttagtgaagctgctcaggggaattctaggagcaattaagagtgaacgcacatcctatgatgtgcaaatctcaaaaacattgcacagcataaaagcagctttacataaaacagtatattctgtctgatttgaattatatgacgtcattaaacaggctaaataatccatgatggggggaaatcagaacagtggttgcctctagctggggagaaggtaaaattgagaagggggatggggaaacttcytagggtgatggtccgggtcyttatcttgacagggtgttgattacacagatgtctgcatttgtcaaaactcatggaatgacacacttaaaatttgtacatttaattgtgtgtaaatcttatctcaaaagaaaaacataacaaatatcggcctctagttaatgacatgggttgacatgtttagagggatgtgtactgatgcctacaacttactcaaatgcatcacaaataagctgtattgatggctgggtggatggaaagttgtgacagaagtcaagtgacatattaaaagtgtagaatctagatggtgttcgaatctaagyggtaraattctacctaggtagaatccacacagctgttcaccgtttgtaaatttttctagcaaaatattargaaaaagactttgcttatggagtccaggctcttttctctgtgaagctgcatttccccaaatgtcggggagacccacctgccctgttaaggaccagcggtgatctcaatctgacactgccacagtgaatgccacaggtgttctgtgccagtcagtgattcrcccttgtcacagttggggaatagtgaaaggaagccttgaggggagcagtggaggtggccacggcccacctgcccagcagactgatgcccaccactatcctctctggagacaagtttggaataagagcatgattctgaggagtcagacagacttcagtttcattcctggttctgacagctgcttgctttgtgaccttaagcaatttgttgaaatacatctgagcttctatttatccatctgtgaaatgggcacaacgcatagtggctggcacaggatggaggacggtccttagcacaatgctaggcccacagaatatgctcaagcacatttcctagaaactgaagggcctgtacaggccaaaaggcctgtagcccaaaagcrgggtttgactgtggccatctctaagaaagaaatgtagtcagatgattcaaaggaaaatgggtaaaagaaaaaaaccaaagctgcaagtttaaaaagtcartgctcaggaatgatgagaggaaagtggtcttggaacacacaggggtgaccactccttcatgatgtgtgtgtgttttgatagargtcggtataattagagatattcatgatccccaaargcctccttatggggtaggggcttaaagacattttccctactcttggcccttccccactcaccctccctctgaccccagggcccataaagctactggagccttgtgtttggggctcagtcaatagtgaaaggaccccaacaacctgaccctgtattggtgcactacagttccatgggcaaagagaaacaagaggggtcagcattttctctggttgagactattgcttgtaccatcgcaataagtgattaaaggctttaccagtactttcattttggctcattgttgctttaattggctactccaacacctgacagctcagctctctctctckcctgctcagctgaactcctgatactcaacagaggaattaagatgcaatagtaaaatatacataaaatttaagacagctattctgcagaagactctccagagacaatgaaaagaccagccacagactggaagaaaatatttgtgaaatatatacagtctcagatggggataccatctgagaaatacatcgttaggcaatgtcattgtgtgaacatcatagagtacttacacaagcatggatggcatagcctactacacacctaggctatgtggtatggcctattgctcctaagttacgaacctgtacagcatgttactctactgawcagtagaggcaattgtaacacaatggtaagtattcatatrtcttaacatctgaacatagaaaaagtatagtaaaaatmcagtattataatcttatgggatcatcttcatatacatggtttgtcattgattgaaatgtcattatgcagtgcatgactttatctgatgaagggctaatatccaaaatatacaaagaaaccctaaaactcaacaataaaaaaaacccatataaaaatgggccaaggatttaaatgaacacctctccaaaaaagaggcacaggtggcaaagaagtattgaagagatgctcaatagcacatgtmattagggaattgcaaattaaaacagcaatgagatatcactacatacctaatagaatggctaaaatccagaacactgacaattccaaatgttggcaaggttgtagagcagcaggaactcattcattgctggtgggaatgcaaaatgataaacgctttggaagatggtctggcagtttcctacaaatctaaacatactcttaccatccagaaattgcactcttaggtatttactcaaatgagtagaaaaattatatccataaaaacatctgcacatgaatatttatagcagctttactcataattgccgaattttggaagcaaccaagatgtcctttgctaggtgaatggataaataaacagtgctctattcagacaatgcaatattattcagcacaaaaaagaaatgagctatcaaaccatgaaaatgtttagaagaaacctaaatgcatattattaagtgaaagaagccaatctgaaaaggctacatattctatgattccaactatatgacactctagaaaaggtaaaactatggagacagtgaaaagatcatggtttccaggagttgggagggaagaagaggcagagcacagaggatttttagggcagagaaacgattctgcatgacactgtgacagtggaacacatcattagtcattacatgtttgtcaaaatccatgaaatgtacaacagtaagaataaaccctaatgtaaactttgggctttagttaataataatatgtcaatattagctcatcaagtttaacaaatgtaccgcaccaacatgagggaaaccaaattatttctcccaaaatattgagggttgttcagctaaaaatgccacaagcacagggaagcacttggcctcggccgctgtttggctgacggcagcacacaagcccttccttactgaagacagcactcgcttcccagcccagagagggcatcagcaggcacaagagacrtctggaagggggctytactatcttcccagatcttcctgccttttaaaagacaagaactgctctcctctttgttttgtcactacataggatttatggctctttgctgaaatactatttaaccaaggacccctaagccattgccttcagaaatacttttggactggccgggcacggtggctcgcgcctgtaatcccagyactttgggaggcagaggcgggctgatcacgaggtcaggagatcgagaccatcctggctaacacaatgaaaccccgtctctattaaaaacacagaaaattagccgggcgtggtggcgggtgcctgtagtcccagctactcgggaggctgacgcaggagaatggcgtgaacccaggaggcagaggttgcagtgagccaagactgygccactgcactccagcctgggcgacagagcragactccgtctcaaaaaaaaaaaaagaaagaaagaaatacttttggactaaggcttcccctgtgtgatgggtactacataaattaataaacttctgcttgtttttcttatgttaatttgacatctgttttcaggagagtttctcacctaataacgtaaaaaggaaaagaaaggaaattatgttttctctcccacaactgcaagttgttgaaacatcttgcgggatgggattggaggaggcatatatgggaattttctgtactttctacctaattcatctgtagacctaacgtttctcaaaaatgaaattataataatttaaaaaggatacttgaataaccccaaagaaaacaggaaaagagaactgaaaggaagggaaggaggaggaggtggargaggaargtaggaaaggtagaaaaagaaccgaataacaggcctaaccccaataaatgctgattctatctacgaatacttctaaaacaggccaaacaaatctgtggtgatagacagcagaacagtgtttgtctatggggtggaacttgattgcaaggagcataggaaacttactaggggtgatggatagttacacatcttgaccaaagtgatggttacaatggtatatacatttatcaaaatgcattaaattgtacagttgggattcgtacctttctctgcatataaatcttacttcaactttttaaaaargattaaaaatgcttccttggtgagcgggacttctgtgtgargcctgtaggcacagcagccatgctgtargcacgaggatgcaagccacatgctcgctggtgcggaggaccaaaagaagaaatgcagccgaaagcagctgcagcagccctggctttcccacctctgaatttcttgtcatgagagaaaaataagcattatgttaaccaggctttaatatgcacaggcaaatttactgctaaatattataagtttattaacatatttagatataagcaggaccagaataacatacctagaacagatactgattttcttgcattcatgtaataatcatttaaaattcatatctgctttaygcgaatagatataaacatagagctaagtgctcctacaagatgaatttttagtaggctaaacagcacagctaaagtctcttatgaacctcatttccccaacatatctttcatctctctctctttttggtttgtttcttgtttgttaagctaatgggtgtattaattccatcccaatgtgactccaaattttgaaattataaggcccaaatgaattattttttctttgctcaaataggatacatacctcatctgaagacaattcaacatataacaaaagttaatgaacggcatttcactgcagtcacaaacccattaagcatcaaatccaggcgctgtgaacatcaaagaagtcaaactgggcaactggtctctcctgtgcaatgggaaaacctcctaatgaagggccatgactttattgttgacaccgattccacttcaaacttggygtctgcaatctctgccagaagattttccgaggttgtttttaagtcataaagttaartaacatgaaatgttgtctccatagtaaaagatgctttcctaaaactgaagggcctctagccaaaagacctacagccaaaaagcagggtttggctgtggccatytctaagaaagaaatgtagtcagatgattcaaaggaaaatgggtaaacaaaaaaaaamaaagctgcaagtttaaaaagtcaatactcaggattgatgaaaggaaagtggccttggaacacacagaggtgaccgctccttcatgatgtgtgtgtgttttgatggaggccagtataattagggatattcatgatccctgtggtgctttggtgggaggtggaggaggacagtcagagacagatgtcttcccagtcyccagtgctgagcaraggatttggtraagcaaccggcagtggataaagtgtagaaagtacaaaactaactccagcccacaatagtcattcactttttgataccactgaaatgacgaagtcaaaagcaatcatgtttcccacttctagaaaaatattcaggtcacaatttgtaaatcttttgtttaatttataacaatgattagcagcatttaaaaatcaactttattgaggtttaatttgcatacaataaaatgtacccattttctgtgtggtctaaggagttttgacaaatgcaaacgcccatgtaaccaacacccaatcaagacacaagtatttccttcattccacgaaggtccctcaaggtcttttgctcccaaccctcacccccactctcacataaccattgaactaccatccatcactgcggattagttttacctcttctagaatgtcatagaaatggaatcakgcagtgtccagctaattttgttcctttgtgtctggctttcttgctcattgtgtatttcagacgcctgctccttttccttgataagggatatcccattgtgtgcatgacccacagtcttcacccagctacctaatgatgaatgtctgggttctttccagatcgaagctgtataaataaaccttgtgaatatctatggccaagacaatgtagatcatggcttcattcccttaaataaatatctaagagcagaattgtcaggttgtacgttaagtgtatgtttaactttctaagaaagaaaccatctgtttttaaagaagttataccgtttacatttctattaccgtgtgcaagagttccagttgggaagtagcctctgagcaggtcgggaccatggggcgatttgcacattcccacttcccttcctctcctactgcattcaaacacattgctctcaccaaggcagactggggatagccacgtggggggactgtgagggtgcgttccctgggatctgccctcagagcaggcaaggcaggtctcaggatgcacaatctttctgatcagagggcttttgagtagttctaccccagtgtgtgtgygygtgtgtgtgtgtgtgtgtgtgtgtgtktttggggggtacatacacaagcccaagtaagtttgtttgaacatattattaaaaatacccatattgcttaacactctgcttttcctatctgaaactggctgagaggcccactcatctccccactctttgctggttgacactttttcaattgcagttcctattcatgtctaatgggaggcagggaagcctagtgattaagagtgagagtgtaagatttcattcatctaattcaccactcatcttctctctgcctcaatttccttaactataaaatggagatattaatactacctatttctcaatagcaaatactattttcccatttggtacatagtaaaaggtcagtgatttttttcctcttcattgctttaataacatatgtggtataaaataacatatccggggtcttgtatttaaaaaatcttttgaggcttgactgtgagcaaggcacaatacagatgtacccgttgctcttgagtgccttacagtctctcaggaagacacaagtcatgtagccactgacctatcatgcaaggaataaagtgataaaagccagcagaaaactcctgagagagaaatccatccccatggatacagctcctcctggggaaatggaggcatgacctctagaggcagggaggactgtctgcactgagtttagaggacagctgtgtgctggaggctgccagtgctcaacaaatcgtgcttgcacttttcactgtgctcaggtgaagtacacctgccagggcctgcatctgtacctgaaggtttccccatcctaagtgtggaaggccactttgcccacatgtgtggtcatctggaagtgctgggaattacccgccamctccacccagggcagccctctactcattaccaatgggtatctacacaccactcccttggctttcagatgtgatgaccctggcatgttttgcaccatttcccaggatttctacagtgatgtcaccacttgatgccattaccactgttccctgtgcttcccagtgaaccacaggatggtgagtccttctctcaggctctgtttctgggagctggagtgcaaagagccccagaccagctggatatggcrgccacaattcagagcagcaatagtgaagacttgagtgcaggccgtgccatgagctggagacagggsacaggtggcagatggtggaggaagaggccctggacagcatcgaggctcacacaggcccaccaggagggtgtgctagcccaccctacctggtacactgctccaacccccagctcagtcatgcattccacatgtgtttactgagcaccacagtatgccaggccctggtctagaggcctagggtatatcagaaaccaaaagacaaaaaagtgcccctgttggctcttacattctagtaaataaatacagatactaaataatcaatcatagtgtacaaacagaaatcataaaccagggtggaaggtgattggtgttttggaaaaacagtagagcagagcaaggatcgctgggagtgctggagagaaggcccagccttatagcccactgggagaagataggtacaaagtgaggaaggaaagaaccatctaaaattgtttccaaaataagagagtcaagacaatgaacaagaaggtatactaacaagaataagagaagatcactcaagaccaaatgaagcagcggttctccaagggcggttcctggaccagcagcatcagcagaaatgcagtcttgggctccaccccagatcggccaagtcagaagctctgagggaggggttccgttttaaggagccctgcaggaggttccagaggattcagacacatgctcaggttcaaatacagctagaaggaaatgccctcctgtgctgggaagagctcacctaktgcaggcgggaccagaaaggaaccacacctgcaacctgaagcgaaacctcagaactcaacagagaataagaaaattgccaaagcactcggggaaaaatggaaaagaaaaagaaggccgggcgaatcccagcactttgggaggccgaggtgggtggatcatgaggtcaggagttcgagaccagcctgaccaatgtggtgaaaccccgtctctactaaaaatacaaaaaaaaattagtcgggcatggtggcgtgtgcctgtaatcccagctactcaggagggctgaggcaggagaatcgcttcaacccgggagacggaggttgcagtgagccgagatcacaccactgcactccagcctgggtgacagagcgagactctatctcaaaaaaaaaaaaaaaaaaaaaggaaaaaagaaagaaatggtccatgaaagaaaacacattatttgacatcagccttctcatcagtaacaacgtatgcaagaaagcaaaggctggatatctccagagttctacaggacaacagtttagagcctagaaatctatgtctaggtgaggcatcattcaacttgcggaagggaaaggcatttctggtcatgcaagcatgaccttctcagaaaaagacacaactcaaaacaaaacactcccgtgataactgaatccaacagtactgggaatcagaggtgaagatgagaaaaaatcaacaaaaactcatggcatccaagtaggttttggttgtaaaaatgtataacaataaaaaaataaaattcagatgcaatccaggtgggcagtggtgtgggaatctgggtaacctgagaggacaggaaatagaaataacagattgctgggtattttggggaatagagggaggagatagctattaattaacacaagacattaatagaagatataggctttagtatgtgaggtgaaaaagtaagactatttgaagaatacaaatagtctatatcaattccaaaatattaagggaaaaagtagatcaaagaaaacttaatcaatctaataattgacgagagagaggctagaaatcccaatgaatcattataaatggaacatataaaataagtcagtacaaatttattagtaaccttaatgaatgtgaatagattgaattctcccattaaaagacaaagacttttgattgaataaaagaaaaaaaaagtgaaatccagctttgttgtttacaagagacaaacatgaagtgtcaccagaargctgaatttagggaaaaaataccagatattcatcagatgcagcagaatgaatcgggtatatcagttgtaaagtcatatataatataatttgaagtgaaaaggttcaaaaaggtatattttttatyggtgaaggaygaaatctgccaaacacatattagtcccttcaccacgcggctgtaaatagaagacaaaactggtggaaatccgaggagaagctgacgaagccacagccatgggggatgarggcctggatggaggccagggcatgaggacttgcaggacggatgagaaggaaagcagacaagggcgtgacaccccgacaaacacacgygggacaggaggcagcgatttcaacaatgaagtaaaacatttgtgatataacgtttttgggaaagccagaccctggagaaagaaggtagacgtcccaattattttcttccacctcacaaatttcattatttcatgatacttgaacacagtaggagccccacagagacaggtcacaggcttggcttcagaycttacaatatgaactatgtggacaggcgtaaggccagtggcagaggcaagcaggctttgcaggaaggtgacaggagggtgctgggcctcaccaaggccagcagaacgaagtggcctgaaattcgcaccggcacgccctgagaaactcagcccttccttctcaggctccaagccyagctttgtgagacctgattgtgaccaccacacctgggacattcctctacccccttttgtgttctctctctctcttctctccctcatctctccttccttctctttcccatttattcattccctccctaccattcattccttcccattcattcccttctttcctccctccctccctccctctccctccctcctccctctccctcccttcctccctctccctcccttcctcccttcctcttttcctcccttccatcctttcttccactcagttgaattctatraaccaattttaaccacaagagaacatcatcatccaagttaatcacgacaaacctcaaatagaacccaactaccagaactcagagagggacaaccgctcatggagagtttggtggtggttctcctggggactcaggagagggcctgtgcctgagctgcatgctgagcacccttaagtcaatcacagttccggaaaaatgattgcacttgatctataccttttactctctctgcctctttcttcactttttcactgttgagctgttcataatttcctctgaaaagggagagttaggaggcattcagaggatctgaagggtaaacccattagtcattctgtttctaagcacctgtaatgtcaaatataattcagggaaaggctgactccgacttctctggttttcaagtttatcatctctgctctctgtatctcctcttgctgaatatacacaagagtcagctgagaacttgataggctcactcaatgcatgttcaatcccacagaaggtacatagtacatgtctgagtctctcattgtaatctgcattttgtctgatgatagcaacacaaatgtactctgcattgtgcaatagatatgtgtgcaaattaatttttcttggcaaattatttgtttgcgaatgatttacctagcatttaagaaattttagtgagatagcaaaagtcaccaaaaaatgtaaccatcacaagttggtgttttctttcataggcttttcctaaattgagaaacactggcctcaggtgttccagtacgacacagaaggatgttagaactgtgtgtgcttgtgggtgtgtgtcttgtgggtgtgtgttgtgtgtgtttgtggatgcatatctctgtgtcatgcatrtgtgtgtttatgtgtgtgggtgtgtgtgttgggggaacagccatggttgttcatatcgaggaataayttccaagtgtatgttgttaatgaatagacttctaacaggatcagctgcatttaaccctaaataatggatatttattgcaagtgtcctgtaccrttagcataacagagcagaaccctttgttcttcttaagtcctgtgcctttgccacagccttttgcacaatcttaaaagcaggctgactcagaattgaccaccatctgctgttcctgacttggaatcaccatgagatttgtgcagccaaacaaccagcgatctgatctgcctgtccaattagttaaataaactgaaagggctttgctgacaaagtagtgataaatgctccaatgataattatagaacagtgttttcacatcgcatccattggacatgtttaattctgcgccaggcatcacccatgtaatttacaagatgcagagaattaaagagtgatgagggggccatggatgagtggactcagctgccatggacactgggcgcagtgcagcccagccctctgtattccatgtccccaagggcagcacgctgaggggcagggtacacatttgctgaggtaatgaaggaaggcagagcccagcgccccctgtcgcctccagcaggtgcaggtgcagaaactcagccacaaggtaccttctttttagcaactctttgaaaggggagatggataaatgtaatgaccttgaaagcaagttctgccaggtatttcgagttgtcgtgaaatatattaaaacaagttcacaatcaatgkgtttaagagtttattaggataggcacataacagaaagctcaaaggacaacaaagctgcaccttcctaaaggctgaccctcaaagcaccattttgttagaactcaraggagaagctcgatctctgagccttccctcctcacagtttgggaaacatgcacaggatgaaggtaaatcctgcataraaatcttgtaattccagaattagtcaaacaaatttgaaatacacacatttaaaaatacttacattctcatttagcrttcatgaagtgattactgacatttacaattacatctgacatcacagagcaagcctttgcagggatctaattcaagcttaagccaaatctatgcaaagaacttcagctcagaggaatagtgggcaaaatctgctgaaaagaactgcttgccaccttgcagataagagcaacagcacaataaagggattccagagcttctacctaaaatagaagggcattatctacaagaacagaccaaaacacaatttatttttaaacaagcccttcagtgagtatttgtctcaggaatctagtatgaaaatagtgtctttgattagtgaatatatggagaattcggattatcatctctatttttagttgagaaaatgcacaaaccatatagatttaaaccatgggttttgcagccgaagtagagacagatgttttctgggatcatatctcagattcccaagctaaagctattgttcaaggtgayggaaatatgtagggggcattaaaccattttgcagctgctagaaagctgtgttttcctgttttcctgatttagacaatggagaagctaagaagagaaataataggaaaggctttcctatgttagttttaaaaagactgtgttatttttaattcaatttttttttgtcaaatctcatctctgttctcctagttttcacagaaatatttacaggaataaaggttgaaacaaaagtacctaatgatcatctccatccatcgaaagattgctcagggataagacactcaaacaagggcttgtgatgaggatggaaaagacaaagcaacttgaagagaaaaaaaaattcttttaaactcagttcatcctgcaaaatggacataacacatgcatataaaggtttgactttttaattccacttttttgcctgatcgcagggaagatggcatgtggctggcccttcctgaagccttgctcctccaccactggctaacagacaggcctccaggtggccttgcaaggccgacagtgaccgcagcccacttccccacatccttaatcagagcctcatgcagttcatccccacattacccaaacataacgtcgtagtgctacacgtagatgtgttgcatcatgatgctatggcaatgacgatgacgcttaggtgtgtgggccaccgaaggcagagaccagatgtggttggtcttgcctggaagccaagctgttgagcaggggtggagtccctctacagaggatgctcaccaagttctaatgcattgtcgataactgtcctgccctggtttttctgcattcctcagattatctgtgggaattgtcctcctgcatcctttctcaaatgacaaagaagaaagaaagagcagtgatggcacctgaaattcaggaatgagtaggcatggcgagctgggtgtgtgagatgttctctctttacattgtctgctttgagatgtgggatgaggggagggagagagttggtcctgaatatattcagttttttccaagagtctcccagaattattgacctatttggacaacaaatcttcattgtcttggtgtccatctccaagtgaaaacttcccccgtccccatggccctggcttgttctgctgctgaacaggtcacctgggcagaaacactgtgtctagcgagaagttagcaggtggcagggtgcacctctccccatactgtgacccttggattccccactgtgccacgcccgagcaagctggggcccctcaggacaaggacgatttgttaatggcctcttggccggtgggcatttgtttacccactactgtagccccaagatcccccaaacaagaatttccatgcttcaaagtaacagcaaaaataaacaggagaataaagcacgtgtttgagcccagtggtttccatcagakgcacaacctgagctgtctggttgggttgctggctctccccccgtggtgggagtggtgtgcaagagaaagcaccacccagcaggagagggacccagcctgccagggaaggttttgaggaactggattctttatcacccatttctccccttgtgggttccacagaggggttccatgacctccctgttgttgagaacagggctgcattcagagaacagacgatgggcctgggctgtgagagcaatcagaacactgtgaaaataggagggctcgttggatcccaggaatcatacacagactgcgttggggctgtgggaagccaaggacagaaatgtctccttcaccccaaatgataagggcaaggattttcaaggcccagagggagaaatgttgcatttgcatttatttaagtgctgatgttggtcagcagcgcatccagccatgtctttagaatcctctgaatggccagacagatggctgctctccacaccacagactgcccagcttcacacatcacctagagtctcgtggccaaggaagttttgccaaatggacacagcctttgtctcccttaagtgttaaacaccagagttccaactgaaaactggagaccatgagatgactttaaaaagaagttccaaatgccccatcgagccgcacaaaacctccatctttcctttcacttcccctgcccctttagttttctattaaaaacaatctgaaccatagcatctatatttcaaaactggcaasagtattaaccctgcaccttgtggcccttcaaccrctccagagtgtcacctcagagaccgatgcattgctaaggcaaaaccagaaacacccyttctctgaggctttggggccttggagggagacacatttcctctgtctgttctcctgcacagtggtggtaaaaagcccacaggagacatgaggcctcccagagatactcaggtaacttctagtgactctgaccatcggtgacccccaggaatgtgttccagtgccccaggcagaatggtgccgtgtctstgtgtgtgtgtgtgtgtgtgtgtgtgtgwgagagagagagagagagaaagagtgcacactatcgactacattatcatagggagaaatatttgcaaatgtaacttttaaaatgaggatataatttaaatggctttgagcagtttttgctgtaaaaatgattttagttagtcatctctttccctcttccttccctccttacccccaattttaaggaaaagagacagagaacaaaagttcyttaagcaaactgcytgactagctccctacttggtgtgtgcgccacccacacttcaggatttaaaatctcargatgctgcatcaactgtggactatgaactgtgctaaaatgctttaaaatgacaactttcaaaacacagtgcatcatctcccgttcacacatcctttargaaacagcctgatggaactttctgcagggcttcctctgtctgagctcggagcactggcattccgggcaggatgaagtggaggcggggccacargcagggtgtctgargcctgccctggctcaaagacaggttgtccttgaatttgtttccttgttagtgttgatcacatccgtagtcaagtgtgtggtaacctcagtacatttggatgaattaattcaagtatctgtgaacaaatccctggcctctctcgccctagccccgtagattatgtgacttcacaaacacctgtaatgcacttcaagcaacttttctcatatttttcaagcttcctttgcaaataaacccaaggctattagaaatgtaagaactaaagaggcacttcctgcctccttgccacctaagaggttaattgcacttctggccattctggaggatgtcaacagtatcacatttagcaagacttgtgctggcgaaatggaggaatgcaaatgtaaagaaatgtttccagtccgaacatgttccctttgaccaaaaaaccagatcttcttacctaattgaataattaattgatttagttttcatcctaggaagagaaacaaatcatttcaatcctaatsagcatgagcaactcaccttttcctcttagatggtggaagtgagcagagaagatattcaggggagccccttagccccrgcctcstcacaccctgatccggaattggtcacattggaatttgaaaagggagggggagtaacaatcattatagagtcacgaaatccccaccgtggcacgccaacacacagcttccacttcaggaacatcaaacacccgtagaaaatacctgcatgttccaaggggcctttaaggaggagacttacaattgtttgctaagattccagtccagtctttcaaaaaaatgtgggtgcccctttggaatggggagttcaaagctctgaggatggtggctggtgwctctagtgtctctagggccmcctcactttcagcagtctgtcccaggtgtcggactatgggaaacaaaacagacagcgttggaagccatggcgcctctgtgcctgcacgtccccaccttgggagagagccccacgtgcggccgtgctgcagatgggcagtatgctctaagggggcccgagtgcctggcgtggggggaggttgaggggtcagctgcaaggaccagggtgtgtctgcccacaggaaacctgggcytgctcttgctgccacctctttgtactgtagtcagtgcccccatgcctgcccatcccctcccccggtcactcagggccccctttacctgtactggttctccatggccctgctctcagctcgctctggaacccaggagtaactgtctgccgcattctggggcttcttctccttcttctcctccctcttcgctctccgcttgcgatagaccagtagccccagagccagggccagcaggagtaggatggccaccacggtgcctaggatgtagaataaaagcagcttttgcccgtcagtgccatygttgttttgtgyggccacggaggagtccccacctgcaggctcctgggggccagaggcagctgtggcgtgatggatgctgggctccctccagacgcctgrggacccactgggggccagcatcttgagtggggcagatgtgatgggggcgtcagatgacagcgaaggtctacttgtggtgggtgtagccttgggggtgccctcggggccccttgtgggactggctgttgcagcrcggggcacggtgctcccttctttctctcctttgtcctcctcatcggggggcccagatggtggtcccagagacacaggccccatggtgcaagagaccccatttggggccagcacccagcctggcaggcagccacagtggaaggacccttgtgtgttgaagcacaagctgtcgcagagggggccccccgggcccacacactcatccacgtcctggcactgagtcccgtcctccccggccaggacgtagccctcctcacaggagcagtgaaatgagccatctgtgttggtgcagccctgggcgcaaggcgagcgacccagagcacactcatccacatcctgacaggccccctctccaggaccgcccggctcatagccaacccagcattcgcagcggaagcccccaggggtgttgacacactcctgggcacagggggagtcctggcattcatccacgtccacacagtccagctgactcgagtccagctggtacccttgggggcagcggcacgtgtagtttttcccatggggtcccaggacrcacgtggcccccccacgacatgggctggagctgcaagggtttcgagaggcacaggtcaccaggtcatccagcagccggaatcctggtcggcarccgcagaggaaggagccatcccccccttcaaagcagtcctggtggcagcccccattgttgaagttgcagccatacttggggctgacacagagggggcccgagctgccccagtcgaacacatcgggggccttctccttgcacaggaaataatgactctgagtctcgtccttgtcaccttccccacaggctacattggccgcakaggcaaagggcacagcctccaaggaggaactggtggtctggaagggggtggtgtaggtcacctgacctgggccccccagggccagaggccggcacatgcctttgaagctgaacttgcacacgaagccctcaatgttacttccgggggagcmtgggctcccacasgggccctcagaccacttggggaggcggmtgggaaggagcggmtgggacaggtccagcagcagagacacacagcgcttggagatgcacgagttccggagctccttgtgccagttagagtaaggcgtgtcctcccccccgcccacccagctgaagcccttcagcggcagactagggtccaggcacttgcccttctctcgctggagcccaatccagaacttgctcatcctcgccgtcagggctgcctcccgcctcaggagctgggccagtactcgctggacgtgctgggcctcctccttgctcttcacagtggccaggttgcccccgttctggttgcagtggttctgggcctcggcagcgctcagcttgcccgagtgggccgtgtagcaggcggtccccacgcagaccaccgcctccgtgtcagctcccgtccccgccccgggctgggtcaggagcagcagcagcagcagcagcaggcccatggaggtggccatcccggtctctgtgtggccctctgygggaggcgagaagcccagcggcgacaggagcttctatctcggctcccagctgggccccaaggggagctgaggggtgagctgcagccactccggcgcagagaaggacacaaaggctgagggctttccacgtycccctgacccaaggcgcatcctgtactgttgtacttcttatttctcaccggatgttggggcttcctgcaatgaatagttctctgactcctgctgccttcatcacggtgctgttgttcataaaaggagtcaggcagctctgccgggtccctggctcagcactgtggaaacagcgacggggggaagacgttacagccccgagatactgccggcttgattttggctccattctctttctcatggcatgaggagcctcggaggcatgccatggagtgagcaggggctttgggggctaggaactcgaggaagctcccttagtaacccataataaaattccactttggtttgcaaaccaccaaaagagaaaaaaaaaattctgagacttaagacacaaggccatggatggttataattttcagccttttttagaagcaaactggactttcyttttgcctagctcatgttctctgttgactttgggagccttttttcttttatcctcccatcgtgaaccttaaatagacaggcattttttaaataggatacgggtcgtgggaatgtctgggttttcaacataatgccaagctcctcgataatgttaatccaaattgggtgaaatttggcagttctgggggtttcatagtggaaatattgcattgtgaggtgtcagggtcacaaaaagcatcagaaagaaaatgaaaatgtgtccggcctcgtggcgcagggcttgcaggctcacttcccccggctcaggattcctagcaagggccggaaatctgggcagggagcgggaatcgaagcccgggcaggccctccygcgacaccgmgactcggcaaaagccagggactcacagtgtgcttttcytgcagccacagacytttgctcattggttgggatcccccaggaggggaccctgagacaggatttggggagactagtttatgtgggaggggaagtgaaacagacaaggaggaagccaacccatgatgacttgctgagaaggtgaccctgggctgctggagccagtgccaggaaactctgggggcctgaggggaccacacctcarcaccatctcagctgagggagaggctccactgctctccaagtcccctgtcattggtagcaggctgtatctctcactttgagagactgactataaattctakccctgcccagtgaccaggggtctctctcacataaaacttgtttctatggacagacacccttgtggctctcgtctgacccatgtccagtttattcctatcaagacagccacttcstaagagatccctgatgggaggagagttgggttggggtgtgggtcaggggagatgcaggaggcagcacaagaagacacaggaarcaacacaagcaccgtgtcacttacagatcccagggagagggcagtgcaccccacggggccagcaaaaagtggggagctgtctgggtcacaaacactcacctggaggggggtgaagggagagagagagacctgggtcctaagcctttattggggtccaggacgtttcccaagcaggtttcccaaggggacttctcactggtgggtttagagcaaacagacacgggctccgtggggtccctgtggctgagaggtgggcatggcrgcatgtctgggaagtccctgtggggtgtggagtcactgagaccatcaaatgggctgtatctgcctgtcccacagggaaatggtcaccaggaggtgggtgtacaaggcagatatctgggttggccgcattgaggaactgggagggggtggagccctagacaccgtgtcaagagcaataaaccctgcttctggtaggagagggtccaaattagattcaaaatggatgcaatgcacaattataagaattctctacacagcggcaactctttggtgctctgcactgaccgtgagggccccaggggaagaagcgccacggtggagaacacagtgaacgcctgtggacccggcaccagcgaccaccacagtggcctccatggagatgttgagttgtcccgggggctaggagctcgctggctccccaagggacaaggaggcatctctgactccagctggatacctcctaagaatgtgccttaagtccttgcattttagcaaagatatttgagacattttgggaactctccatagaagccaccagaccctccctgtgccccttcattcatccatctgtttgtccatccacccatctaacawttgttgattaagaccctgctatgcactgagtgaggcactggattccaggaggggatccctgcctctgtgatcctggagtcctgttagagtggacaactttgaacaagtcacggcactgatggctttattgcaggcagcacaggggagcggggaggtcgtggttgatacaggggtggcatcctgactgggggatgggcaattaggagagactcctctggagaagacaggcagtcaagccggaatctaaaggagaagcagctcagatgtggaatggtgtcgggatgggggaacagcatgtacagaagccctggggacagagagtgagtgaagggcagggagaccaaagcccaggcagtgggagggaggatgcaggggaagatggagccctgtgaaccccagtaatgaaggcttgaggcttcgtcttgaaatccacggggaaacactgagggctggcatgaggcctacatgtggaaggggactggtcagtggacccaagcagtgggtgggggggccctcagcaggtggccgcaggtttccaggctgtggagtccaggtcagatgttytcggggctgggtggaggtggggggaagggcaccgggcacgcagaaggactgcatggctcctgccgggagctggggtcctggaaggctgtgtccgctggaggtacctggttctgagaacacaggggattgcctcttggggctcagggtctcccagaccccctgtccttgtgacctgcctcctcgggacgctaagtgtgccaccagagctgggtaagcagccagctgtgaggggtccagggaaggctggtgtccctggctcccagtcaatatagctggccatgcatttgagtttggcaagggtcagtcttgttctctgcttgggagaagcttcatttctaagggtttatttacaagcaggtaacttcttaacattctgtaaaatcaattctgcagccctagcatccactcatagcagggagccgttctcgtggtctaggcccctgtttgtgcagctcggaggtagattcctcagaggtagattgtgatmtgcagcattcgctcagcattctacttagttggtgcttaaggatatgggctaaatgagtgactttcagcatgttagccactctgacccccagatctttgtcaagatatcttctttagctgtaagttattcatcttccatgtgggaactttcaaaccaattactgttcacttagccaagtgatgacatcttaaagaagaaaatgaactagcaagacatatactctgttttttatccattaaccttggaagtatttgtaaagcaccaacagtgagaaagactatgtaaaatgcagaaactgccttgccctgggggtccttggattttactttattattttcagtaacttggttaactcagccccacttctcatctataaatgcagaggtgggaacagggcctctggaaactttcttgctctaacattaataaaagtgaaatcatgcttaactctcccctctggaattagggagaaagcaagttgggaagagagtggacactgagaccattgctgagccctcgacatactgcacatgtaagcaaacctctgtctaaactgcacacacccaatttcatcccaaattgacccgctgactgccaagacacagggtagtttcctattccttgtcccccacatctgacttccactgtgtcccttcaccctttggctgatccctgctgggctcaggtgggttaattcacctgggacacttacagctaggttctctagctccagccccgcccttctgtgtccgctcccacctataggggacgctccttaraggctgttcaggggattcgtagaggctgagggcatggtgcttcgacctcaggggaggatgaagagcttgcttttcctgggagggatttggtggagttttacaaagaatttaagatagtctgaatgcaaactttgagggaattctgcacctcacatactaaattccccatggatggtgtttcatcccattttatttagagagcagattataccagacctctccaaggaccgatacttaaacagcaggaatcagcagaaggagatggaaaaagtttttctcggcagatctttggacggaagccacgttaggtgttctagaaccatggcgagcctaacagcatggcatgtaccctgagcaaaaggctcctcaccatttgtgtgtattctgcagtctttatgagtactctgagctttctttttaaattgccttaaaaatttactttgcacgatgctggaatggaatgttctgatctcaaatatggggcgagtttaatctcagttatttgggagcagactaattggtttgtggatcattcaggcatccrgcctgtctttttcctttttttttttttttgtaactaaaaattaaattaaaaagggaaacaaagcacactgcgtatttcctggcataacatggtatatggtagactcacaatgagcaacagtggcacagaaatggtggaggaaatgaaacagaactggagtcactgtgacctgtcattctatgggaccacttagggattttgtgttcaaagtttaaaacagaaacagagtgaaaactgtgagacctgatatttttgtttgtcagtacagattttagttcatacatgaggcgcttaacagaatttgaataacatttttgtaaaattgaaatttgtcctttattaatygtttgctttaaaacttaaaaaactaggaaaatcactaatattgattatgacatgatgatttctgaaagtyattgtgttgtacagaggtgaggggtgctacaargttcaccctgggcacaaagatgccaggattgctgcaggcaaccccactcgaggacacccgtctgcccttgggggaggctcatcgattgaccatctgtcctgcattgagagggatagaggctgggggcagtggctcttgcctataatcccaacaatttgggaggccaaagtgagtggatcacttgagcccaggagttcgagacctcatctctacttaaaaaaaaagagaaaagatgagtggagtgtggtggtgtgtgcctgtagtcctagctactcggaggactgaggtgggaggaggattgcttgaaccaggaaggcagaggttgtagtgatcaagccactgcactccagcctggaagatggagccaggccctgtctcaaaaaaaaaaaaaaagagagagagaaaggctggaacctgtctgcactgggttacaatcccactctgtgacttacagctgtgtgactaaggtcacgtctgagccactctgtccactgttatatggtacagctatctgtgactccacaccctcagctgtctccgactctcacagggctttgtgagggctaagagagtgcatacctaaaagaagctcagaaaagcacctggcaggaacagtgaattcctatcacaccaggacacggtggcctgagaccaccctgactctactcccgcaactggaactggggcctcagccagttgctggctttgggattgggaccaacactttcacttcttggggccttggtttcttagtttacaaaacagggaggataagagtcatgatgccgctgtcctgtcagtgggattaaattaaaagaggtcctagtggtaagtgcttcctgcaggggctgacacgtggccgacatcagtggacaacagtcatgtcaatctgattgcaatgagcagagacagagcccacacccccagggcccatccctgccaaggcaaaaatgaaaaggagtaaaacctcccttatgtttgctggagacacggagcttgtatttttcaaaaacttccctggctttagagtgtttgtttggatcctaggctgggtaaacattcttcttagagtgttattgatttttccacatttagtaaatagtcttctgacataattaatcatgtaccatatttatagaaaacttggctgggctgaatgttgtttttgaggttaacttgtgctcacctcttgacactggccgtgataagcaaaggctactcaccagcctttggaaagagataaatcatggagggaaacagagttttcagcaggatcgggttcacacatttgatctccagggacagctctgagcatgaaatacaagtctctaaattatgctcacacagctggtgtggatgatttcaggttccatttgacattaacagcatcctcagtgattccagtaagttgtcgtaacaatttagccatatttagacaatataatttgatagaaataaaaatgatctatttagcctaacttgtcaagatctaattcttcagaaaaatgagaacaatgacatcacagttgtttgaaaagaagtcatttaatttgaatagataagcctgcttttccgggaaaatttaatttcctttgggaagctgactggggaattctgaagattcctgaggagtatagactacaactggaaaggaagacctcacaagcactggttgagaaccctccagtgctaggtgtatttaggtccacacccaggaacccttgggatgagggtttgcaaccagggagactgtccaggagcaggaggaagcgctgggtctcagcccagtctcccaaggccaggactgctgcctttgccttgcygcatctcagtgggcatccccaagctccactgacttagcacaagatgggaataatagyccctatcttctgtagtttcaaccactagtcaaaatgtgccacttactagccacgtgcccctgggcaaacaccgttcctctctgggcttcagtttccttacatgtaaatggtgtcacatccacagagscatgaggattaaatgagatgactcagtaaagcgcttggcatagtaggtggtaagtctgtggttccacgattagtggtatgaatacaatctcacatttactgaataacagttctaatgattatggttattatttttgccctaggtgattctctggcagggaagtcaccargaaccctccagaaggaagaaatgtctagcatgtcctaggtccccgcacccttgcaaagacccagagatgaagcaatgctggatagaccccacctgcacacagagaagaaaggctgctggagagacatcatcagaggagagagacagtggctctaatccaagaatccaggcaacrtgtgtagggctcagggtggcatgtgtgtgttttcatgcccagcaccaggacctgagcactgagagctttccctacctgccatgggatcctggtatcaaggtgttgcccgaaggtttcagcaccatgtggtcaattgtccatgcatctttatgccaatctatcatccccgctgctgggtcccagagccattcaagttggtctgaggcattcagggcttgccatctcccagtgggcacaaggcagctcccctgyaagaacacttcccagctttgatgacctaaccctccttgctggggtgcagataaaggacacggcaggtgcactacctctgtaaccctcactcaaatatgccagtctgtgggctcatatgccttgacctccaaagcacagacatgccagctgggcataagctgggacccctttggaggggagccagaagcattcagagccatcagcaaagcagagtctgcctctctgcagggagctgtctgtggagctccctgtgtgccctgatggtaggattcaatcgctccacagaaacctggaattctccctgttgtcctgaactgtgagaagccaagtcctgtgttttagatacaataccatctgaattctgctctcactgctggcccatgttctgtggcttcagccgagtaattcmactctccagggctctttgtcatccatctgtgagagccagtcygggcagagaaggagaggagcagggcaagctgagaatgcagcccatgatgccgccccgattatggtgtttcctcactggacacgtggatgaagcgtgctcgggttttgacatctcataaagaatgagctgacagaattgggtttgattcagtcattttgaaaataagcgaagttgctttttgatatcctttttgtcgaaaatgacaaatagcttgcctttgtgtatacctgcctcgtttctcagtccggatatatctgtttcttaggaagtggggggaccagcaggaggggaggaacatggctgtctcatggccccagcagccagagaaagcccccaggtaggtgctggctgtgacatcaggtccccgtgcactaaaatagtggggagcaaggagcatgggtagggcacatgcccagtctgcccctggtgaaatgacagagaagagcccttcctagttaggcattcaaatcacgactggatcccccaatacacaaaggcgtggttgatgtttccatgccagatcctagcacggaaagctgttcacccaataagcgtccacccacgcccccacttctggcctgttccactgatgaaggtgcccgtatatgtatctgtctgcccatagtggggtttctttgcctgcttttattttaccagtggctacatttcatcatccagcttcatttcccatagaagttctgaatgttgtctggttttcctcgaaactatgartcacactgtgcacgccctacctctctctagcattgtaagaaaagcactcctctgtgcaggacacaatcctgtctactgcccctgagagccctggttcatctcgtccctccattccagttccttctagaaggtaaaagttggaaagtgacctgagcccagtgcgggacaatatggcagtgctcttcaaggcctccgctggaacatcttgtgtctcccaagctggatgctgtgcctggtcattggagaaagtaaaggcaaagcctcaggacagcttccagacaccagtctcttcatcgggacgaggtcagctgctggctcccaggttgggtccagctcttcatcatttactattagacccacacagtgttttaaatatttcagtgaattgtgcatatttaagaaatgtgagattttacagaaagatttgcatttctggcttttctaaaaaaaaaaaaaaaatcaaagtgtcttgcaatgctggcaaccagcccaacgtggcaatcagtgcctgcattagcttcctccttagtgccgccaggctggctcctgcagccctgggagcctcaacatcactaaatacctataacacaatagcctatgcatcttctatcgaaagtcatgacagttcttcaaatgaaagttagctgggaactatccaggattctccctataccaagcttgtccaacctayagctcaagggcccatgaggcccaggatggytttgaatgcagtccaacacaaattcataaactttctcaaaacactatgagatttttttggtgattttttttttagctcatcactatcgttagtgttagtgtattttatgtgtggcccaagataattcttcttccagtgtgacccagggaagccaaaatattggacatcctctttataaagcagggagggtccttctaattgtaacatcttatgaattcttgaagactctacaactgttactctcccttattcttcttaagaccagctccactgtgcacctgatgctagtaagcgttgggacgtgctgggagactcccctattcaggggacaaccctgacagatctgagcaatgatgacatttctgtccccagctgacaccyggctcaggagggacctggctcaggagggacacagactggcccatgtggcataagggaaagttccatatgcttctgggaaagtcccccttgctcttaaacagagactggagaaatggccagcctgtcctctgagtgatcttctgagggctggtgtgcaaagctgctgtggtcaggacaagctggctcagaaaggtggcaaaaagagggcaggagctcgggtccccaaaagcctcctggaactgtgggattcaccaaacctgaaatgatcccacctgagacttcttatatgaaattattctcattcttaattgtttgagcagttatactttggttgttacttgcagccaaaagcattttctccagacttctgagtcctaaaaatttcattctttgacayaagagctgacccagaggccctgaagcccctctcargcctgcagagctttggtctgtttgctgaatcagattcatatctacacaacagttctagggccaaattctgctctcccacactcccacccactcatattggaagacagaagagtcttctagctgaactgtttctggtgaaagagtagccttccttcgcgggcactgacactgagggaagcagctcagtggctacttccacctgcagatattccaggtggtggctcagaacwgctgacaaccatacctggggaagactggcctttatttttctggttgttcatactccaacagctagcaccgtaygttggggtccaatgaagcgagcagcagtagatggcatggccagggcaaggcagacacgctggagcagtcgggaaacctggcatctacacccatgcactggcaccctcaccttcctgtttcccgtgggaacaaagtgggcggcaaatgcagggtgagatactgggtcacttcaggctccaacttgcagaagctgtttcagacccacaaygggagcaggctgcatcttttgcctactcaggataaaacgtgacactgctgcgtcatacagagatagttctgcatggtttcctaagaaaggcaaagccagaatgcccggggactaccagcattttacctgagtaattaccatgtgagcatgttatcttcargaacaattttgctgtgctttaataatttatctctgagctaaaaaattataattgaaaatgataagcactttcacgagttgggttgccacactgcaaaaccaatttattgcacagaagattataaaacacatttccattcaactcagtctcaagtgatgggcargttggaggggctacagaaccacagtagtattargaaactgcacaactcgtataccaaataaaagcatcaaggatatgggggcagctggaaagcagccctgctctggttgagggttactgtcgacatctccctgtaatacagcaacctgattcctaaagaaacagatacagtaggcacttcactcaaactaatgctctcctcagcccagggcaggggagctcagccacaggccaggtccagcctcagctttgccagatccttgcacgggtcatggaggaggctcctggacccgtgcaaggatctggcaaagctgagrtccaggccagcacagcccagttctctcctcctgctgcagccaggctctcagcacgtgcattcwcccccactgctttccatctgcccacttcttcattcatggctgtcctttctgcctctctggtgtcctggggctgctttcacgtcggcctcctctgacctctgcaggccaaccacatgggccccatcagtcctctgctccctgaccctcaggcatccctcctggaagtgtccagtgtgtgggcaccaggtggtccacattccctgggcctcttccctgctctggcctccacagggttccctcctgggccctgtctctctcctgcccaactcaccgctgctcggttgcatccactccccacatgtctcctactgccccatctcgcggcctcacagatgtgcctgtccacatcaggcctgtcctttcatctcccaatcagagcacccagctgtccactatttcccagaacatctcagagtcaccaagacccaaactactcycacttcctcccccagtccaccatccgtccagtgatccacgacgtgcargcggcatccttcctcccaccttcccagcctctagggatgatctggctccawgccctgggccagtcctctttttccccgcccatgccccacctccaccgcctctcacatgggtgggcacagcactggtgtcctgaccagcccctggctccagcctcatcccctatgctccatgctgtaaggtgagatcatgttgaaatagaagcctgatcatttgttttcccataagcacacacaccacagtgaaatgctgctggggcttgccattgatcataggataaaaatcagatttttttttttttttgaggcagtctcactctgttgctcargctggagtggcacgatctcggctcactgcaacctccgcctcttgggttcaagmgattctcctgcctcagcctcccaagtagctgagattacaagcatgtactaccatgcccagctaattttttctatttttagtagagatggcatttcaccatattggtcaggctggtctcaaactcctgacctcaagtgatccgcccacctcagcctcccaaaatgctgggattacaggcatgagccgctgcgccaggccaaaaatcagatttctaacacggccctgttagccctgggactttggtccttcttgttttcttttttctttttttaattttttttgagacagagtcccgctctgtcaccaggttggagtgcagtgacgcgatgtcagctcactgcaacyttcgcctcctgggttcaagttattctcctgcctcagcctcccgagtagcagggactacaggcacacgccaccacgcccagctaatttttgtatttttagtagagacagggtttcaccatgttggccaggatggtcttgatatctggaccttgtgatctgcccacctcagcctcccaaagtgctgggattacaggcgtaagccaccgtgcccagcggatccttcctattttcatgtccacattccccagccacagttctgtgggccacccagtccttccacaaggccaatacacacacacgcacacacgtgtgtgaacatgcatgcagactgrgtgactgatgaactcttttaactgcattaggccttggggagctttgcccatctycccactgtagattcagcctcctggttacatgctctcactgcaaacctctcaaccttgctcctcttcctcccagaactgagcatagtggtaactttgtatatgtgaaattgatctcccarcagtaaactgtgagacagtcagagctggaaactcatccctcttgtctattgctggctccctagtgcctgctatagggagcaagtgatcagtaactmcttgatcccagccatacatgggaatcacctggggtgggggacaaaccatagtaccaagccccattctggaccaactatatcagacttgctgtgrgtgargcgcaygcgcacacacacacacacacacacacaggtgattcttacaccagctctgagaagcactgaggttgggaagtgagaggtggagagcttgctagcatgaatattgatgtcacagcgtgaatcttcactgttccttgttcctttccccaaggccaaatagaagagtcccagatgttctaactagctttatttccccaagtgtcagcatttggccagcatgcctgaagatctagaaactgcagcttctctgccacatacagccaatgcttcaccacccgccttgtgcagggagagcaagcctcagctttgcctgtacactgtgctgtgcacaccagrtccccagcataggacagtaacagcacaggcactgcaggggacttcagggaggcctgaatggccctggacccccagcccagacttctgtgcagaagagttaagagttattgagtgactgcaacctaaaggatatttcttctttaggtcatttaactacactaccagcttcttgaagccaggggctgcgtctcgtggaccttattgtctgctcagcaataacacagggcctggtgctttctgacgaatccacacacatgcactgagtggagctgcgctcasggatgagcacagctgcatctttcacggaggctgctttcctgtcagcttgcatttccctggatctctgtgtactgtggagtacagggccttgggctgagcccaaagcattctgagcaaagcatgcatgtatgggcatgtatgggaactaggagttctaaaygctttcccttaccctgtccccttaatcctcttaccaacctgcaagacaggtccttccacagtttcatgtgagatgagtaacggcagttttctcagctgttaggcaagctgatgccttgccaagctcaaacctggaagactgatgttgaagaagcaaggagggttgaaagagccatgagtgaacaaggagccaggagtgatggggagccagtagtgatgggggagccagaagtgatgggggaggagccaggagtgwtgggggaggagccaggagtgwtgggggarccaggagtgatgagggaggagccaggagtgatggggagccagtagtgatgggggagctaggagtgatgagggaggagccaggagtgatggaggagctaggaccctaacttatacctggagtagaaagagtagggacatgaggaggagcatccactgaaggagtttatgttcctttttgacctgatgtgcctccagaaatggagcctgacagaaacgggaatctgcagccaaagtcctttgccctctcttggtcaggctttgctgtattaattccatgttcatgcaaacatctgtgcatgagtgtctatgacaactgtattcacaatagccaaaacytagaagcaacccaattatcyttccacaggtaaatggttgaaagtggctcatccatactctgaaatactactcagtaatacaaagtaatagattgatccacacatctacctggatgcgtctccagagaattatgctgagtggggcagccataaccagaggttcatgttgtatgcttccatttatgcaataatcttaaaatgatattctatcaattctttcaatggagaacagactaatrgttgtcaggggttaaggtggggtggagtcagggggcaagtgagtgtggttaaaaaaggacagcaggagtcatcttcatggtgacagacatgtgccgtgctctgcgacagggtcagtctcctagtggtgatagtgttccatagctttacaaggtactatcacaggtaaaactgggtaaagggtacatggaatctttctgtattatttctcataagttgtatgtgaatctgcaaatatctcaaaataaaatgttttattaaaaaaaaacaggagagattctcagggcagaagtttayttatacattgcataagaactagatgcaagtggctttgtcacctgttcgctgcagggaagtcacacccgtccaaagggccaccagcatccacctggatctcatgaaccaaaggccagtgctcattgcccagccccgcaaagctgaggtgttcagtggggccagagctgcaggccctgggaggggtggggacaagctttgtgccaagaaggtgcaggaagccatccagcagggctttgayggtgcagtgggcactatagcytctaccatcctaagaagatgctggaactgtcaacacaatagccagtcctctgcaggcgctgtctccagaaagttctgttaaaatgtaacacactacagaagcaaaggaacaccattaccatcataacatcagggatctgcagcacttcctgtaasagcctatacactaaatattctcagcttggcaggccactggtctctgttgcaactatttaagtcyatctttgaggcttaaaagcagccatagacaatatgtacagcaatgggcatggctgtgttccaataagaccttctttacagaaacaggccgcaggctggtttggtccacatgctgcagtttgcccacccctcccattattttatatgatgtttttgtagtttgcggggcttgttggccccagccaccactgagggtgcatggatacctcttagcaggttcagaggtggacctctctaactgaagggaagcatggggcagctgagggccggataagagcctggggttctgggaagggtgctgaagaccagcttggatacccacactggccctgtcaggggtccttagagccagatgggaataagctaaaaatggggtgagatgttttagccctcagtattgatgtcaacggtgaaggtgtctgggtctttctccccctcatgccagctaagggtatgttaattcaccctgaatctgcccaggtcaatgttcaagactgtgcaccaggaaaggaaaacacttcatggagcaagaaacccagggctggcctagctatgkycctaacagagcactcactcctgcccagtgttgctggaaaatcaggggccgattgaaagcgccttccctgggttgtgtgacagtgagctctyaccactagacaatgggatctttatctgccttagggattttagtaaaggtgatctttcacagtcttgccttaaggcaaaatcgagccattgttctcatgccttatttcttcaaaaccttctgcccaggccgggagcagtggctcacgcctgtaatcccagcactttgggaggccaagacgggtggatcacctgaggtcgggagtttgasaccagcctgaccaacatggagaaaccctatctctactaaaaatacaaaaaattagctgggcgtgatggcacatgtctgtaatcccagctacctgggaggctgaggcaggagaatcacttaatcccaggaggcagaggttgtggtgagccgagatcgcaccattgcactcagcctgggcaacargagtgaaactctgtctcaaaataaataaaaaaataaaaataaaaacaaaaaataaaaataaaaataaaaaaaccttctgcccagctcttgcctgcatctggatagaagactcctggagaaacaaacagtagaactcacagaccatgttggctaccaagttccttctctaaagcacacgaagacattgggaaatgactcaaatgccaggaaggaagtttaaaaaaaaagtggaggagctcatttaaaagaacaaaaaataatgacaggcaagctaaaataacaagaaaagatatgacatcagctcagggttttttttttcctataaatgatgccaactcccactcagaagagttggagttggagaatttttccttggcgggtaggggagggaatgtgtgcagatgctttctgtgaaggtgggataggtgacttcctctgtgcccggttacctcgcatatgtcatgcccagcagcsgggggaatcttcaccagctgaacccatcacataaccagctcctagatcaagaagcagaacattctctgctccctagacccccgggtcattcccccaggctccatactscccrctctgacagcagcgatggtcacgttgggctgttgagcatccatgcatgcagggtgtgtgctctttgtatctggcgtctttgggcaattcatccgcattgtgtgtkgttgcaggctgttcatctcactgctgagtattccactttgtgaatatgccacggttttgcaaatctattctgctattgatgagatttagatggtttccggattttgttgtgcatgatttgagggagacagagaagggcccaccactccctgtgatccatctgagttttctgaaaggcttccctccaggcaggttgctttgcaggcatcactctcaccccactgttcttagccaggggagttccctgaggggcctgcacaaagttgttatcgactccccgacactcaagcaccaggggcctttcatcccagcagaagggagaggagaggtaactggggcacgttttgcgccttcaccattgtatgtctgagtcatgatktctttacaactcctyagaggtcctccgcatgcaattccctccaawccactsacaggcagcctgaagacctggttargtaccgggtttgggataaaatagacarccttgccctcaaggagctcacagacaagttaaaaactccaaaaccaagtttgattgatgtaatgccagaaaatgtagccagagtctggcatgcgagagtagcgattgagggtctctctcagggaaggaggggaaaggggtgtagcaggaaattagaaattagtagagaaatcaaacttgcttcaagaaatcttaagtgaccgactgcactagacatttattacatggaaagaggagtcactgagtaatggtattggtgtagaatcaagtaatgattgtgcacagrattctcttctctttgtggttcattgaattgttgtgacttttatataatggcctgcagaataacagtgcacctccacaaaacctcagttcagcctaaagggaggctttgttgaagtgaaaaggtgtttttgaattttcctgttttctttggtttatgcgctgagtgctgattcccatgtctggtgacttgtcactcctcgatgaacagaaactaccagagacaggagtgggccaagggagttggcgactgtgaggtgaggtcggggtcctggggaggarggtggagggtggagaaagaataaagaaagaggatgtgctggttaacattgagagttctgactaacacagagggtctctgtgctgatttgctccagataccacaggaggtggccctgtcagcctggaaccggcatcgggagtgcccgtgggaccatttgattgacactttgctcctccagttttctgatcagaccgtgacttttrgctgtgatattgtccaggcctgccaaagtccactatggatgccaggttcagggacccattctgccctgcagttgaccyttgtctcytgctcaaccctgaagcccctgcagtgtgtatagaccctggacccactgggctccagcactgcctgtcacacccctgcaagccaggtgaggctggctcaggctggtgaggaagtgcttgtgaggagagccagggctccaygccagggtaagagtaggaccaggaacgatgtatttggttattgacttttcctgcttcctgagctttataacaacacggggaagagggtcctgtgatcatctcaatttacagacaaggagactggggtatgtagagaccaagtttttgtgccaaggctgtgctcaaggtgagattcaaactccaggctctttgacttccctacactgcctgtgccgcaacctcgggagcagaaggtccggaaatgtggggcaagaagtcaggggccggggaaagagccaatgtggtcaccattctgctggaggtgggtctccaagtgtctcagctagcattgccctcaaagatgctcagcaagttctttcacagtaagaaatttcagagaaactccaaggagcttctctggaagagaacatctggggaatgyctggcttccatgcacccagcccagtgctggttgctagaatgcatagcaatgacctatgagcagtgggcccagcaaattattaactacagcttttcaggaaaaaaaataacccatttgtatcatttgcctctttccgtggtataaatacctccaccagggtcagcttcagtctccycatgatgttgtggagcatggagcarggaggaggtgtgagcagcctgccgcggaacaggaggctccacagatgcagataaccttaagagcacasgttgcagtaaaaatcatcaggcatgcaggttttactatttattattttaaaaaatataatttacttacctgtaggtttacaaagtttatttttaataatgactgtgtttaagaaccagcttgtgagattcctggaaatttcacaatctgctcttgcaaacaagcctaagtcagcccaggccggctcccgtacaccaccaggtgtgaggcctccagctctggaaatctgggcagagaaggggtagcatgaaaagaagtcagggttaaccctgtttaaccctggtgcttagttacaatgcctaagcatagaatgataaaaccttcaaacgttagtgtcaggggatgctgggcaatcactggttctacccctgcaggtagaatggaggayttcagttcaaccggccagctacgctccaagcctaatatggaagtccaatgttttcttctgctggtgtggtgcagggcacggatttcaggaagtttgtcaaattgtttattctatgagaatcaagagccaggatattgtgtcagccttgcctgwcagctgttgtttatatcacactcggctcctgtctctgggcttctttgcagggccagcttcgccttgctgggtgccctgccattctgctgtcagtggagcactgctgaccacaagaacaatcgagcaaaggctgtgctgggaggtgctggcaaagcccatgagagaaactagaaaaattcatgtttcatagacccagagcctctttagagtttcacgcacagaaggacctgccatgtgagcagtggggctgcatggcccagcctgagtgctttgctctaagctgacctttggggtcgtgcactgtagtaacttagggctgcatccatcctgcatgaggctgctttcctcttctcaaatattacttgtttaaaacctactttcagaaagacaactagattaggaatcgggaatgctgtgttatcgcaaagctggtagcaattttaaaatcttgaaagaagcttgtttccgctgtgagcctcagtattcaaatatacttgtttaaggtattaaagctctagctcactgatgctataagagtaaaaatggcaagatgtgaacagatttttaacactctgtgtgttaagatctgttagtcaccctcagcctcggcattgtccacatctacatcatctgctttgacctggagcaaacttattgactctccaaagacctcatttttctcaccttgacctggtgataacccatcacttggaaaagcttttgtgggttacatcagtttccagcaggcacatggctattagggggactcagcctcttggggataaaaagcaaagcaacttggagagttcatggcgccrtggggctgcaggaaggaaggtagccctagccttcagccccagaactggctgcaggtgaacaatctgaagacaatcaagtccagactggatgtcagggtcccaggggtcatgtggtggatgattagagaccagagtttggaggagttatgccaaatccccrgaagcatggaaatcccccacctctgccgaatgttactggattgtgagctccctgccctgcagctggtcagtgaggctcccacaaatcagtactgacaaatccacatccaaaaagcccactcatactttgtagctcttgtacattatttgtgatttaaactattagtttctctccctggtttaaagaaaggtgcttggggaattttggataactgaatacctgccatccctagatggtactcccaagtctatgagaaagggaggttttaagagaccagaccaggcctaagttgatctcttacacyggagagtgtgatagagttaggggttttgtttgcatgcttttcagttgtgattttaaaaccacctacctttctctcacccatagtcttgatacttgatgtgaggaataaccagaagaagtcaaccctgctaacgtcacatggcagggcacacaagctggtggctgtgttattttccaactgaaaaatcatttataaatcattaatatatggattccaccarggatacatacaaaaaaaaatggtttagatagaggagcctactcaaacatgctcaagcctgkgtgcagacatagactcactcattattaaagcttaccctggaaagagccacgtgaatctttttgggaacaatcatcccatgctccagctggagggaaccggaggcctttttcttcggccttttgtttcacagatgcaaagaaatcagatccagaaaggttaagtgacttgaccatgttgaaacatccggttagcgacagaagccaaactaaaatctaagttgtatgtgtgtgtaagtgtgtgtgagtgtggtgtgtgtgcacgtaggtgcacaggtggaaaatctgtgtgtttttctccagatcctcgctcttaagagagtccattctaagacaatcatcttaattacaaaatcagtgttctgcattaatatcatgaaaccattattgaaacaaagtagagtattgtaccaattcaacaatagtagtatgattaggtaaactgtcatgtaaacacatgatgtgttatgcatcaattaaattatgttggcaatgagtttgtgcatatacaaggcaatgtttatctttaaacattcaagtaggagaaacccaagatctgaaactcttcagagtaacctcaactatatctaaaactttgcagaaacctgatgacctgcctgcagtgagcctctctgggtagtagactatggatgactttttggttccaaaaacatctctktrttaaagtacaattcctaaactggaaggaaaatgggaaggtgtaactagaagcttgcatgcgggctcctgacctggagcaatttggtgactttgcctgttttgcagctctggtcagcaccttggcacatccagggaccagaggttgcaagaggacctctttcttacaaagtcagcagttttgttccatgtctggcatgagttcagccacacaaggatggctctggggttgaaagtccccttttctggcttcctccggtgtgctttactgacctacctcagagaccacatgtggcccttggggcaggttctcaggcaaacgtctgccccactccttgagagagaaaatgggctcccagtgccctggactttgaattcctttgtgtttacttccccaaagcatcttgagaattcacaagcttctaggcttttgctgtgacctccagtgggtttagaatgcaccacgcaccagagaggagaagccaaagggtggatgcgatggtttccagccctggctttggcgtccagtgggaaccgggcygtctccccctgctttcccctttactgaactttagtgtggcttgtggtagaatgcagtcagttcaggctctgtggccacctgctgagtaaagactggaccctctcctgaggtccaggcaggccatgggaaatttgagttwtgttcattaaacaatggcaatctctgcttttcattttcctgacttggagggacttgctggggcaggcaacacgcccaaggtatttgttagcaatcacgatatgttgtrtggtgggctcggccagatatgggaggaagctgaagtcctccatgctgctcaaaccaaggacactgcccaccgccccaggactgtacaataataaacaagtccttccaytgaacactggggtgggggaagcagaaggtgaagctaattttaagtgtccaggaacttatttgaaacaatcttgacccaaactgttctgaagttctgtaggaaattgcatctgctatgaattgtggagttggagctgtctagaccaggatggagggatataggcagagtgatgggtataygcaaatccatggaggagaggggtgccaggaccctttacaccccaggagggcacatgggaaggagggtctggtggagaggaagctgaagagatggctggctgtgggtgtggagttcagactctctccaagtgcgtgtgtgttttgggccaggctgggaggggcaggcgtgacttgggccagctgtcctccaagtgagctccccatagtagcatctgcagcatggaggatcttgttacaaatgaaagttccggccaggtacagtggctcacacctgtaatcccaacactttgagagcccraggcgggtggatcacctgaggtcaggagtttgagaccagcctggccaatgtggcgaaaccctgtctctactaaaaatacaaaaattagctgggcgtggtggcacgcacctgtaatcccagctactagggaggctgaggctggaaaatctcttgaatctgggaggcagacgttgctgggagctgagatcttgccactacactgcagcctgggcaacagagcaaggctccgtctcaaaagaaggaaagaaagaaaggaagaaaggaagaaagaargaaggaaggaaggaaggaaggrargaargaaggaaggaaggaaggaaggaagaaagaaaagttcctamccctggattaatgtcctggggctgacaaaacaaagtaccacaaactgggtggcttaaaatgacagctctggagactagaagtctgagaccaaggtgtcagcaggtctgcgctcactctgaagcctctagggaaggagccctccttgctcctctcagctcctggaaacccaggtgtccctgggcttgtggccacatcactccaagctctgtctctatcttcccatggccatctgcccccrttatgtgtttacatttgtgtctctcttttctcttcttatgaggacctcagtcacactggattagggcccatcctgaatgtgcctgcctttgaacttagttacatctgcaaagaccctttttccaaataaggtcacatgcacagcactgggggttaggactgcaacatctccttttggggaaattattcaacttatcacaaactccgtccactgaatgagaacgctgggttttagcgagccctccaggttaagaagtgcttaacctggaggttaatgtgcctgtgtttttccaataaatgctcagagcctgaggcaattggagagcatgtctgtagtttgcaatatacagggttactcaaagtcaggcttgggaccagcaagagttggatccagagatgcatgatgttttagcagcaatgatattcatgaagctttttgcttcactccttgttatggtttgagatcccacagcagacccygagacaaagacctggaggcaggtggttaacttgggaggtggggtcaggggaagggagatggggaagggagaggagacagggcaggtgcttcccgagactggtgctctgttgggagctggagcacagtctcgaaaggacaggtgtgaaacgtccaagagctgacctgccagcagctgcctcctgcccctcaccacagagggtggctgaagcttttatgccctggctctcccagctgccctgcacgggctgctgctcaggctaaggaccgagaagtgctgatgcttgagggactcatggtcagtgaggacaggctgtgagctgagctctgagctcggggcgaaccaaagatgggagaggagcatcagtgcccccckccccatcaccacattagaatcctgcgggaactggctgggttctcgaaggcgttgttatcgccctgtgctcacacataaggaccctgagacccagggccactagggtgaggcgrcagggcagggcctgatgcacctgtcgaaatccacttctagctcccaccctgcccccagagacatgcgccccatgggccggcacacagcaagggrcttcggggcagggtgaaaaaatggcaaatacacacatttaagccaaaataatgaaatggccctggccctatcagcctcgaagctacatcaatgtcactttttttaaaaacgtaagaggrgctgtgaggacatccagcccrtggtcactccaaacctgccaccacagacagttggggcctccccggwrtccgtgggccgaatttcacaggcgagcattcccaggggtcctcaccagctgacttagtcagtttgggctgctctggcagccccacaggcaggggcaaaggcagaaatgtgtcttctcacagctccggaggttgcagtttcaagatcaaggtgtgggtaggcccggctcctctgagcctcactccctggcctgcagatgcccctctcctccctgctccgcgcacacagtcctccctttgtgagtgtctgcgtcctcatctcctcttctcgtaaggacatagtcctattgcattagggtttcmgctagcccccagggtctcacttaccttacwcactgctttaaaggacttttctcctactaaggtcaagttctgaggtgctgaggtgacaaggtcaacaaatgaattttggggacacaattcagccagtatcacttacatgtyctgattttcctccccaaaattctacatgctactagttattactatgcccattttagaaattaatgagatactcaaagaagtgcagtaactacagcaaaatgccacagctcagatgtctccagcttcaaaatccagaagacccagacagctcctccagcacaggaagccaggacatcagctataacagctgtgtggttcctgcaggtggagtttggccttgcccaggtccttggaggcacgacttctgtgtctggtggaactgtgcagcrtggctcagacccacaagctgtgtgatggcttatcatccctgtgtaggcagggcatgctgagccaggctgactggacacctctgttcaggaagcattaccatcctaccagcaagagcaggtgaatagtttacatggtaattagccagcatgcactgttcccatgtgttcattcatttgttgaaaaacaaaataagacaaaacactccttcctggccctactagctccctggcttttctagaatatgctaagcacaggccacttcagaaactgtgagttcacctctccccctgcctggatactctttcttgtggtgttstcctcatagctcacacactcagcttctgcaggtacttgccccctcccccacattcccaggtcttacctccctcacctccccatcttccttcattgcactggtcaccttacagctctacaagagcagaggctcgcctgatgtgtgactaatccatccttagtacctagagcagtagctggagtatgcatctacgtggcaaaggtactacatgaacacatgggttcagagttcagcccattccacatgcatctgcaactcttcgtcaggccccagaatgcagcaggagtttgatacctgccatgggggcataaggagcagcaggcattgattgatggatgggctgccttactctggtttctgcaaataaaaataagaacaatccagtcaaggtagacaggaaaagccctgttaaatttctcctatcagcttgccactggaatcctgctgctgttgcagagacctggagacatggatggctttagaggccccagcaggcacaagacctggtgcacaggcccgagccaggctggagaatgactcagagggcagggaggatagaggaccaccagccatttgtccygtgagttgcattagaccaggaaagccaagaaccacttcaactagttgaggaaagctgtgcctgttatgctatgtccttcagagagctttacatttttacgaagtccagaatagctgttggtcgtctcacagatacttacttaccctgctgcctcaacctccctccaccattcactgtcctgatgaaatcagatgatttgcgagcagagcaaccttgaggggaaatgacagcccctgagttcagtgtagagtctcaggctgggcacagaggccaggcagccccccgtgggcctggggtgggctgggcactgggaaggaattggcatttgctctgcacctgctctgtgacgaggcacacacagtttacatctagggtgccactgcattcttacattttattttaactttacattttattttaaagaaactcaggcttggacagtgaaagagacttccttgtctgtgggcacacagccagccagcagcagaactgagcttcttcctgctcccagaccagcccttccccactcccccacaatctagaagctgttctggaagccgctgactgcctcttgtccttgagcagacttcctgaggtctacaccacctctctggttcctggagcaaggaaggcaggtgtttgtgtcttctggccaaggattctcaggaaccaagagaagggatggtaactttgacayttctgttttcagaattgctccttgttcttcccaccgcattagagcatcractgctgcttcctccagtgggacccatcctggtgctggcaggttgctccaagtgtgggcaccgacacatgctgggcaaaccagcccttgaaccaagaattccatttgctgagtctgagaggccaggttctctttggagtctcagttgtagcctgtaacatttgggctctcataggccatatttcccacygctgtccttaaatagtactttagtcagatcagataacattaccatacgctctaactctcctgtaactactaaaccgaaacatttacaaatatgataaaacaagcctagaacaccagaatggttcaatttaacacagtgatgtaacacaacaacaaaaggacagttcctggctaacaccaagtctcagccttcagagcgccatggggctcacagtgtaggttcccccaattccgaattactgggaaactccatttgcccagcagggcactgggcccatgcggccttcatatgacaaggaagtatcatttaacctgaargactgcttctgggtcctttttgtttttgtgtggttttttttttttyyttttttyytttttttgacagagtcttgctctgtctcccargcttgggtgcagtggtgagatctctgctcactgcaacctccgtctcctaggttcacgcaattctcctgcctcagcctcctragtagctgggattacaagtgcctgccaccatgcccagctaatttttgtatttttaatagagacgggtttcaccattttggccaggctggttgtgaactgctgacctcaaatgaccctctcacctcagcctcccaaagtgtgggggttacaggcgtragccactgcacttagccatggttttatctgccacaaagaaaacggttctattgggccctctaaatggaagcatgggctccgagaagtcccagccattctgagttgcgtagcrggcctcccagtcccataggcctgacccctacctctttttctttattgccacccaaaaatgtcccatacataacataactgcagaaagctgattatcccaaaggagtcatctgaaaacctgagttctgtaaaacactgatctagactttt

SEQ ID NO: 13299 - DNA, 57917 bp, Homo sapiens
gactcactgcaacctccgcctcctgggtccatgccattctcctgcctcagcctcctgagtagctgggactacaggtgcctgccaccacgcccggctaattttttttttttttttaatttttagtagagacggggtttcaccatgttagccaggatggtctcgatttcctgacctcgtgatctgcctgcctcagcctcccaaagtgctgggattacaggcgtgagccaccgcgcccggccaaaaaaaatttttaatgaaacggggtcagaaaattaaaattttccttctctacacaacctccccaaagaaaacacaaggcgacgccagttaagttcaatgccctaaaaaagtctccgtattccacctattcattccgccctccatcgtcgtatttttaaaagaaacatctaatattttaaaaataggaaaaatagaaaactgctttccaggctgggcacagtggctcatgcccgtaagcccagcactttgggaggctgagatggagatgggcagatcacttgaggtcaggagttcgagaccagcctggccaacatggcgaaacctcatctctactaaaaatacaaaagttagctgggcgtggtggtgtacatctgtaatcccagctactaatgaagctgaggcatgagaattgcttgaaccctagaggcagaggttgtagtgagccaagattgtgccactgcactccagcctaggcaactgagtgacactctgtctcaaaaaaaaaagaaaaaaaaaaaaaagaaaaaaaggaaactgcttttcacccttggactggtaaactctgtcaggcrtctagactaggctggggcttggataggtaatgggaaccactagtagagccagaggtgaacatataacaatcaccatagcactcatagatgggaactacacacttaaaatgactgcttgcccattttacagatgaggggactgaagctcagagagttgccaaggactgagacccaagtatcctgactccaaagaccaagtgttcatctaccttaccccaggatctaccacgagagttaaactggtggctttggggaagaaggatgagcccaacctagcttcagctgactgccctctttcaacttgtccctgctcctcccacccttctccctccacacacacatttaatgcagcttctaacatgtactgataacattattaccttctcttcagggaaattctgagaatgctcttgttatttaaaaagttgataaattctgtccatttgcagtcatagtgttgtatagtaccttatttagagttgtgagtatttatctgttatagaagaactgccgtatacatccttaagtcacggtaggaaatattccaaattagaacatccactccagaagcttaaagtttccccaaataaatcttataatagcatcacgttgccaaggtccccagaaatcttctctgtggaaggttagcaccctgtatcccagcaaatcaacaatgtggctttcctgtctctgactttaggcctcatttgatgacttgcaggttcccaaaaggcctcacccctgatattaagccaaagaccacagacaacaaggtcttcttgaktctatagtcttgtatcttcattctactctaaataattagctctgtgtgtgtgtgtgtagtgtgtgtgtagtgtgtgtgtgtgcgggtgtgtgtgcctatgccctttgaattgtcatcaggtgacctggggaccagggaaggttgacctgaacatgggagtctgcccacatatccctttcacagacgtccccttctcaatacttctatggctgtattggaaagcctggcaaaaatggctctgccattaccttcctgcgtggcctttagcaagacactccgcttttctgggcctgtttcctctacagatacagaatagggcaattagactaagtgtggataggaaaggatgagcagctgggaaggaatctctgttaccctcttcctccggcttgctttctctaatggtcagatagatttctagcccccaactcctactcaggagactcacagaaggatgttcagggatttctgtgttttccattcttatttctaaggccttgaagggcccaaatttggggaccctgtactaggtacattattctccattctccaccctccactgtcctgccttttgtcttggaagccaacttctacagactatataatcagggcatgttcaccctctggctttgactgggtttggccagtgggagacaatggcaagaaggattggaggattggaggagaaaaaagtggaagtcatactctcccagtgcctccctgtgtttctggcagtggtggcatcatgtgattgcaacaccagttgggcagcccctctccctcacttcctgctgtcactggttttcatcacaaaattccctccctttctctgctctggtccaggagtgctagaaaggctttttgcttttgccagtccctaattagttccctctgccctgcacacaaccttgtgaatagttcttccagtaaaccattttcagtagacccttggaacgtgctttctctttcctttcatatctaactgatacacactcttgctatttttcttccaactttcagaattagggttctaactgtcccagctgtggaaaggttcatctggaagacctagagttttgagggacaaagcaagggtctcttttctgttgctgggcacctgcctccagttgcatacaccttctctgatccttggtgcgaatgagtaaggggaaagtcatctaatgctactgggtgacatattttaccaaacactcttctattgctcactataattatgtgaattgtgtataagctgcgttcctctcataatttatttcatttttgggtggcagacttccaaattccctctcttttattcatgcataacacatgaatgattcacaagtggtaaagtcaacagggccccttccgcttcagtccccatctgtaaaaatggtttatcaacctcatgttgaggttcagagttggtataatatcaaccctcatattragggttggtgtgaggactaaatgagtaccatctgtaaatccttagagcagcaggtgcaaagtgctagcccacaccatgagtatttgctcatctgattcatctcggccccctttcctacaatttatatgtaggaagggggaaaaggggacttcggtaggaatttctaagtgctccctccagcttccggggttttccgcagcaccccttcctctctcaacacccatttctgagtagatttccttttccgcaaccttttcatcccaggaagttccaggaagggcaagaagggcaattgcgattctcacgttttctgctcttaattctaaaccagtgattgtcaaatagaggcctagggagccccactgaccacagaaagtgggttttgctctaggttatatctttgttattgctcttatctgtttaagtttcaagattctgtttgaacaatggtttccaagtctttaaaaagtcgaaaatcccccttcygatgagatacagaaaccccagactttaaaactctcagtcttaaacctctttggcaccattgccaagaaacttttctctattccattcaaatagtttgtattctttgccatttctgatgctctgaaacagatattcaaacaagcaagtctttatgtatttatctggagtgtctttctcaagcactcagcrtgttcagtagacatttgtctccttaatttctaggcccatgggaaagataactacaacactgtttaacaacagagacatttgaaggtacaaaactttactggaacctgatccagccgctgcagtacttccaacccatagaatccagcgttactagaggaccgtccattctggttccagaggctgctaggagcgagaaaagttggagagcagaagctgtacagggactgagtcccggggaggagtacccagcaactggaattggctgcgtcatggggaggagagttagcaaggtactaacactccaattggctaacacataatttctctatgcagcttaagacttcaggcagacagatatgaacacatgaagggagtaaaaactccaacctctggaccacttcctggagtgctcctaacccagactcccacagggcttcctcccatacttcatttaggtctttggctcaaatgttacctctttagaactgcctcaagactggggcaagaggagccccagtctagggctctgagcacctgattctcttccgtccatgttcctttccatagggcaagaaatcccacgggccaacgggatgtactcactcagagctcttgcccctctcctttttagagcatactgtgagttcctgggaccctagaaaatagtgccgcaatagcaacaggtcaccagctacaggctgcctcagccttttcccaaggyctatcctcctgaggagcaaggggtggtcaaggggaggctatttgcaggtgtggacaaaactctgatgtgcagatgtcgttgttataggtgtgggcaaaaggccatttgaagtatgggacagagctggggtgccaagagaagaaggaaggctgagggccaaggacatgttccccctccaaagcacyacrttcgagggcgtatctcagaagggtccaagaatcctaaacttaaatgtggccttccagattatgatgaaggtatacatgtcaagataaaaggataggaattttacatcaccgtttaatttgtagttttaaaatatgtagacatgatatgtgggcctccatttgtactactgactcagttcttgcaaatattaagggtagacctgtccctgatcttcgtgtgtaaaatagcacctyctctgccactctattcttaccccagtctacatttcttcataacatcggtcaccatctgatctacatttacttatgtatcatctctttacccccactggaatgtaagttccacgtccctagagtctatattttgtttactgccttatccttatacctaaacaagtgcctggcaygacaccactcagtaaaacttgaataaatgaataacaaatctaggctcaaagctcttacaggtgaaaggggctaacctggcagtcacaaaggaaaaatatcactgtgacaaccgtctgaggagcaccttctccccttaaaataactcactcaaaacagtggagctgcaaaggtgaccagagaaaatccattaacaccttagtgcccatgacaccaggtgagttgatcgggctacttgcgagagggacatgtgagtgagcgtggagagctctgagtaggctgaagagctggatgtgggggatctgggctgctgggaaccccgaatgttggaatcgccctgacaaccttatgagggtggtcagatatgggtcctgaggaaactgattccacgrcaactgcccgccaacccagcacaccccacagtgaagaggggcttctgatccatgagtagggcccctcaaatgatgttcccctttagatggtcatggtcatcagcaggggtgggtgcatcgatcctgtggggtcttggtggtcgcagaccaagcgtccctcttytcacatctaattcacaacgtctcatcgctccgcgggagcccaggaactgccctacaacagccgaaatccgggtcgtctattccaacggactcctcttccgttggatacgggggccgtgagaggccaaacaacctccgcgaggctacccccgcagcgaccgctcggcgggcgctccattcctttaccggactgtacacctcgcctcctggggcctgaggcgggaacccgggtcgcgctgctccgaggcctcggcggaccgcgaaaggatggctcrccrcccggccagggccagcccctgcaacaagctcagccccgcccgctcccgcgcccaggagcggccggcggggcggggtggctgggccggcctcgggggcgggggctcgggggcgggggctcaggggcggggccacgtggctcctccttgcgggcggaggcaggcggtgccgcggcgccgggacccgactcatccggtgcttgcgtgtggtggtgagcgcagcgccgaggatgaggaggtgcaacagcsgctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaaggtgagaagcgggggcggcccgctcccccgtgccccgccgcccggacccctccacctgcccggtgggcagcctcctactccgggagcgcgtccctcttccagtcacctccgcccacctcttcctctccgcgcatcccacgcccmccaccttcatgtttctcagctccatttttgcctcccgctcccttgccttttcctcttggccctcatcccgagcttctttccctctccgcggcctgggcccccagacctgccctgctcgcccggttcgtcccccgccaggttactgcctccttccctgcgagaggtctcctttgttccttcctccgcatggtccgctgacaccttaccgtttcctggkccagccttgtggcagtcctcttcctctcgtccagggacccatgtcatcttcctgccaggttccctagctgctgtgggtcagtgctggggagaaaagggaacggacatccattttgcctccctgccacctttctccactcyctcgactggttgaccaggtggtacrtagacttcctttctcatttttgtctttgatgtgggtatgyccacctggcagttttcctatctctgttccgggcctctcctgacytgccgcctccagctccttagcttctgggccacatccttctctctcttcccccgctcagacccttatattttaaayccatgcacccagaggcctttggtgcgtgtttggctcttgctccatgttcccaatccctggttggggcaccaaaactatatttcctgaattccaagacaccatcaactgtgagacacactgttcattttatgacagcccaaggggtagaaggataggaaaaaaccactacatgtataaagatttgaaggtgaactctattacagaaatgctaaaattttgaaacacttaagacttagagtcgaggaaatatggtaataatagtaattaatatttacggagcacctatcatttcaggcaccttactaagtactcggcatacattgtctcatagtttcctttccacaatttaaagattcctgtggtgtcacacatccrcctaaycyaggtagtgggtatttggcgggcaggagtggtatagtgatagtgatttgttcctgacttgctgcctctgaatggagttacttcctgactctggtgctaggtcgctagcacggcctcctaccctgaaatggtcattgaatgagaactgtgggcatctttggaaataggcctttttctagagaaaggggaactggaaccattgttccactgttggtatttcttgataaattcaactctttgtggtagaacagtgcctttgtagatgttagttttcagactcaccctcctcttttcctgagcagcttgcagattggtttctgaagaggcgagatggaaccatgtgtacatcttttagccatatggtcctggaaaattattttyaaatgaaacttataagctgttttgacctccagtttacacttgcctacatgcctcactggtcccattagctgaacgtgcctttctgagcagtgcttcacaccatttcaacacatttggtcaggggaggagtgatgtcaacacatctggtcaggggaggagggaggaagaacatggatcatggaactggaacacctaagataaggtaatctcaggggacattgtgggcatgaacatcataaaaattcccagatcgctttccactttgaggttataagaggtgttcagtggctgcagatggacttattctagaatttcttccttcttgagagtgctggggggaaagattagcttccagctgactcacatgtttggcctcttgcaatgcagrgtttttagttttcctatgagttgcatgtctagatactgacccattctgctcctggatgagggttaccacttccaaacaggattccccagtgcatggagcctttctctaaaataagaaagcgaaatcagaatttaacctctgaaaaggaaatggaaggatcaaagtctgtgggggtgagccagggtaaatgggaggtgggagatttcagtggaaactggaggtctcctgtgagccattggtgtgagtcagtccttgagccagatcgtgttgggagggcactggcagaatctgctgtcagcctgcaatgaagaatgtcctccactctaacccaaaggggtgttccctggtgaggccctgctgagaagctagggttggtctcgcttcatctctgtgtcctgaggtttcttgagaaaggttggttgtgggcccgcagagggctgtgctcatcccaccctgggctgtgtgagtactgcccatgctctctgctgaggacacctgtatcttgaggcaggaacagagacagagtgaaggtcacagggagagagaagaattttgcagccatatttggctggcttcaggcatttaatctgactgaatagggttcatttcttcagtgactagggcagtagattctctaggcacctgctgccccggggcagagcatgtgtttctgagaacctggtttatcccctttctattccagagcagctccggktgtctcactgtatgttttggaaactggttgtatccaatttagaccttcattgctattcactggctaatcaatcagcaaatatttgttgagtgataagcattgtttgcattgcagttggggaaatgagctactcatagaaggaaaattggcaactgttacaaagctgtgtttgaaaaaggccaaaggagtggttcagccatttcttatgggaacccaggggaggggaaagtcacagagggctaatctgatcmccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtrgaggaggaaggatactccaggtggaaaamcagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcrtgagtgtagaaccttctgctggtgccgtggatcctcttgactcagaccgggggtgtcagccaggtgtgaggggtagagaaggcattttgtccatccagtgacrtcactgcccagaaactgtcagcaaggaggaaggaaggcatgagttggtgaycgcatagtgctgactagctggacagggcataaactaactctctgtgtcaggagagctcctgaattcttcggtgtagagtccagagctgagggtcagtagattctagtcactagaccaccaggtctgactggctcttggtggtttgggtaaatctgtgcctctgtcttcatggaagtccagacccacttaacactcggaggctgcatgtttcttgttaagagttgtttgccatccagcacctsaacggttgtcagagctagaaggggcattagagatcattcatcctggccctcgctgatccaggaggaagcagaggtccagagagacatgtggagctcacggtgctgcagccagttaaactccaagcaaggcttcctgctccacccagtgccctccctgcacttgtgagtggggcaggggacgctgcccttgactccagaccaagcccccagtgggggctcagcagaatccccacaacaccccctaccagagggcatcccctcacccatcaatccaagatttacagctgtccaacttctcttgcctcgccacccttcccctctccattagtccatttattctgtggttggtagaaaaattacgctgttcagagcaataattgcaccaggaaagggttttctccccagtagtagagctagactgatactactgatcattttggtgttaggcatttaagacacctgacacttcaraaagcctctgtcacccagctctgcattgcgttgacagtaaagcttaaatgcagctttgctttaacaatggagcactcacataaggaccttctctattccatctcctgttacttgtcaaaagacaaaattacaccacattcaaaaatcttaactggcttctatttgtgattctggaatcggacaacaccacattctgtcttacagaatgagtattctgatgagctgagcagaggagtttggctttatagacagaaaaaggctgaagaaagtagaaacagatcaaaaatctgattggttatttcggtcccttttaaaggttaaagcagaggagacttctgtatgttggctgaaactggcttgtttgaagatttgactgttaactcactctctcctgatcttggaaggtcagatcgacagcttagttttggcttggtggcgtggaacttcagcttgagggactccatcttggtttggtctcttgggccttgtgcaggagctcartcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagayatttaagactctttgagaggatacagtgtaacagggaaactactgtaatgactctccccaggataatactaagagtttacaatatgacgcttagccagggacccatgaaccaaaccaactaaaattgaagagatcaaagaatgagccagatgaggaatttaccctttttaagcaagtactatttgttcatttttttgcaactgagtctcaatacactatgtgtctatccatgtgcaacagaaagtgtcagcaattgcacagattccctgttcgctagtaggtagcagttctattatctagtatcccatgactgggttaaattaaagcaggaagtgagaacacatgggtctaaaagtctgactctataaaagggaccactagtacagtttgaacaacagttgtgttagggatgttgctgaagttacccactgggcagactaaaggatccctttggtcatgtaaagatctgggtttagcgtgacaaatccaacagtttgtgaagttacccacagaagccactgattgtgaaattctaactacagcattatcctgccagacaaaaaaaggtagatgtaatcaaggataaagtggaagtcttattccaatgaaactcttgttcagaagttttgggaaagcatgaagttgtcaacttcttgtcctggtttgcagtttgattgtctctggttatggcattgggcattttggtgaactctttgtgtagcgtacacgtcaggcatgagacttgtcccttgaaatgtatatcaagttgttcagcttctgtttatagggctttaggcacagaacagttcctgttcttagttggagaattgtagctagttattggaagaaactggaaraattcagaattcaatccatcttataggtagatgataaaaacttgaaaatgatcaacaaggctacaatctaataacagatgtactatagtttttctttaggaacatattttttctctctatagtcacccccatttctaccaaagataatcagggtaagtgggaggcagaggtcacagtgagccgagattgcaccactgcactccagcctggatgacagagcaagactccatctaaaataaaataaaataaaataaataaaataaaattcagactaatttgcttgcagaaaatatttagtcacatcagacttggcctaattatttacataagtgtggcaagaatagtgattgaccacgtaggctcttcttaagtttgctttgctagaacttatcgataaggaatctcagattggacttttaacaacttctcaaggctaggaagtcaacccaagcccaacttcagatttcacctgcagtacctatagattcatcataggtatattctcaagtatggcatcacactcaaaaccttggtaatatgaccagtgtttcctattgtatcctgttgtaaagagagcagatacttattgaacttatgcaaataacagtattgccataaaaataggaatattcacaaatagtttctgaattycagagaggtcttgtagggagaaaatgtttccatttttgttcacaagagtatacttaccaaattgctgtaaactatagatagcttaaaagaaaataagttttcttaaatctggacaacaaaacattaaaaagaaccagcaacgtttcaaatttaaaaaccagaaaaacccataattcttcattagttcatttagtctcatgtaattaattcttgttgtgcttgatcttggttatcagttttgcagacccatcagtttttttcattagagttctggaaattctttcccagtccaatcgtattatctcgaagttatcagaaatggtacttatcagagacgtttccgtggatctccttgaagatgaagcacttyaggattatagttgcttagaaaaaagcttttagaaaaacatcagaataaagcaattaactgtagacaataagacttaaaatggttgtggttaaagatctgatgagagttcatagtaataatgacacaattgacaaggaaatctggttattgctgtgcatacaacattttaacctaataaccaaaattaaggctgataatgtatcatatttctaggaatatcatataattttggggatacaccttaatagcaagtataaacatacatcaataaatataactcaaagaagattaaacatcatttcttgtttgacaatgcttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgagkcaggaggataccttgagcctaggggttcgagaccagtctgggcaacataggaagacccyatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaagtcacagtcattcatctaaccagaatgataattaaaagacttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagttttagttgcttatattaattagtttttactccttagtaatcttaatttctagtgaaaactagcaagcattgtgaactgtcttctattaacattcaccatttcataatttctagaaacatgtttcctcagcttttcrtgcttattacagacccaattatrttctctatgccatamaaaaacaagatgccaaagcatatatactttagacttatgttcagcaattaatgtttcagtattttaatttacttagaaatgatattttatgaatatctatgacttaatttaacgtaaaataaccgtaagaggaggctggatatgtggrcaggggccaaatgaagaactgccttctggttgtagattttcttctaaagtcagttagarcccccagagaatgttgaatagagattgacataatcagatccacagaaagaaaagatcatttggtggctagagaggscagtgaggggtggagcacattagaacctcaccaggagagaaataatatgttgatgtttctctggaagccctgccatgagaacctgtactagctcatgggacacggagggtaggttggaggtgaggtcagtaaaaaaccagatcacgggttcatgccaacctaggacaggcatgaagagatggaggtttgggtgagggaagagacttcagaggagagtggacaggatgtggaggcaggtggggatcagcaatcccctggtaggggcagagggattgcatcctgggcctggcatgcaacaggccctgaccatacctgcctttgtgcaggctgccttgcaggtgaggtttaaagccaaaggatgcaccccagcttgcagatacttggataggctcaagttgctatccttgtgtgctaagggagtcaagaaggctccccaaaaagtgtgtggtgggrgggtgttgaggaggttggggaaatggcatcataggatgtagctcacctcactctgctaaatacttttgacgtctgactctggtaaatacctccatctacttcctcttcccaaccccccacccacctccctccttcgaggagtccagaagctacaatgccaaaagcagactaccagcaagaaaggtgggggaaagaagggggtggtgtggccacaggccttcctcccagctcgcagagccccctcccttgtatcagccccaagaagggccagcttagttgccttctttccagggatgcgtcagggtgtgccaggctcttcctgcatctgtctcgtggaggtgaggstaacactccttccccaggcgtaacgtgttcttaggagctctgataccttctgaaattgtgttcttctgagacgtcgtaaggagtaagttctagggtggagtattagggtgtttttgcattgataaaagtaagtacctgaggctaggtaatttataaagaaaagaggtttaattggctcagggttctggaggctgtacacagcatctgcttagcttctggggaggcctcagggagcttttactcatgacagaaggcaaagcaggagaggaagcaggagggggttgggaagtgccaccctattttaagcaatcagatcttatgagaactcagagtgagaactcactcgttaycaagggggcagtgccgagctgttcatgagggatctgcccccaagatctaatacctttcactacctaatctaatamctttcacctygtctaacattggagatcacatttcaacatgagatttggaggggacaagatccagaccatatcaggtggggtcagaggtcctgctaaaactgtgactatcagggatgttattcagatattagtgttctgtacttaatgggtgctgggtgggctgcctgtgtaaattccactccctgcccctggggcatgagcttcaaatgggaattgtgcctgccaccaggcaggcctcctcctcctctcatctgcttcagagacgcatgtgggtccagctgccatggacgtcatcctgagctgtccaggcagacactcccagtctggtctcttcttgctcccttctattctggctcccatgcctcccaaaaaccctcctctccaggcagcctggtttctgccagtcctctcctcctccaccttgctcaggcagttccctgcccactggaccgacggtctaggttcaactctgtttccayctttcctgctgagcccatgccttggtctgcagggccgacctctccaaacttgagagttctgtgccacatgatttggcccctgccactgccctctcacggcttgtgtgtcttcctctgtgcgcaccttggcttccagctggagcagcctccatgtgggtggaactttggtggatgctcacggggcacctgacctggaacctgagctcaggagagctgcctggtatatgagcttgtttcttctcagttcctgggctgtggcccagaatggtgccattattytctctgccaatgtttcagcggccagcagccttgtggcccggggcctgatgcaggggccagactctggcctcaaggcttctttccccgcagttcctggattccagatgctcctgtttctgtctggggacccagttcctgataccctttaccccagtcactcaagctctgcccactaccagtatctctggccccaggaaacttccctaagggtcccctggggaattccagatcccctaaggcatgttctccaccctctggaactgatcccatttagagccccagggacaaaggcaataccagggcttttcctggggggtgrggggctggggggatggcgaggagcagggcaaactccttcaacatctctcagcccccatccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtaccagcccctcttatttacccctgggttttttgtcctttcagcctggaggccggccctgtatctcgccgccctggactgtgctgaggagaccaacagtgcagtctgcagagacttcarcatccctggcttcccgactgtgagggtgtgtgactgacaggaggggaaggcaggctgggcctgctttgtttccctttataagggaaagggaccatgtgggatgtgtcgggatgggcagatttcagctgctctgatttgagctgggaggtgatcatcacttgggctggtgagagctcccacctcccaaggtcctcttcaattgctctccctcttgacctccaagccttaagaggtctgatctaactctataaaaccaggattcaggctctgacccacctgtgggcagggtcagactctagaagcctagtggtcccccacaaagggaccccagacactctggcaagcctcagcctcctcaggcaaaaatgccttgaaccacaggtagctaagaagggacctgtcagggtagcctcaccccactgtcagaatgtcagtgcctcaggcagcagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagctataaataatatgtaccctcccaccagaatggcatctagaaaascagtttcttctgtagccattaaggattattaggaaatgcctttgaaagctgaaatgccaagcattgtccctggaacaagatacctctgagctgggggtaggggcagccaagtttcaagcagaactgtgagccagaactcagcttaattaccccagcagcatccatccgggaagtaaggccgtggctccaccaggaacatccmgctcyaactccatgtgacctttctgttcctcgagcccagtgcaacccccactggattcagggtttccacacctaatagaagtcccttcctaaactgttaccacatagggtcagggccccccaggccccaggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaagrtgtgtaattgagaatattcaaacagggcactctgttcctttggctgaaccaggktgagtggccctgagtgggaagctgtgggcaagttagtgtggcacaaggaaccatcattcacaggctgatatttttctcccagtgagcatgagccrcaggggtgcagccactgcccagcccccaggggaggggttgacactggtacagcagccagggcaagacaaccgattggagttctgtagggcctgacacctgagctttctgactctgcctgggagaggctgggcacagcagggatgaaggagkcggcctaggccyaggaggtcagaggctcctcagcgccaccccatgtcacgcagcgcacgcagcctggatgcctcaggtgagtcaccatctcctgaactgcctggctggctgtgggaggggcactgggagggccctcgctgggctcctcagccctcccctgcctccagacgggcagcacctggcagggccagtctggtagtcatctgtccacagaccaacacggtggcctcccccggcaaagcctttcctgcctctcctgaggaacctgtggctcagttttggccagggggaggcacccagtgcccagtccataggccaagtggcttgagctggcaggtctctgctctgaggtcctatgcagcggctctcaaatagtttcttactgtgaccaactgtaagcaatacacatttttacattgtgatcccaaagttggtatgtatctattatcattaaaccagaagtttcataaaacaagattcttactaagtgcagttaaactgtgatattttctgttctatttttttttttaaatccggctgtgattaaatacattgatttgacagctcattacaaggttgtttctagtgtttggaaaacactactcaaacagattccaatatccagagattcggggccatgaagaacctgtgtgcccttggcagaggctgacctggagactgctggtgggccagagacatagccctgttgccctgcctgctgcmctctgggggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgyctccagccccttgtcactatgagcaaacagtgagcttctaccagcccagcctgtttagcaaacacctgggccctgaagggcgggccagctgtgtcaggtccccatcaggttggagccagagcccagctggaaggaaacaraggygtgggagagggaggggctggttggctgcaggttctggctggagcttggcaacctagaggctggaacttccrggtcaaggggcttctccgtgggcctcaggagtgcccttcagtgggaatagaatgggactttttatggccgaaggcctggccggarcaaggggtacacagcacagcagcataggggtggggaagggcaggtcttctctcttcgaggctctgaggagatcagtgatgtggtttcaaatccaggcctctctgcttactgtgtgtggcttggaaagtcacttatcagtgccccagccgtgggccccagtttccttgtctgtaaacatgggatgataacatccacctaagaggaccgttgccaagtgtgaagtgaggtctcccatatgcaagtgccaccatgctagtgtgatttggacttcagtaaaagttagtttgcttccttcccgttgtcccatctcactcctgggccacccrtggggctgctggtagctggtgtgtggctgctgctggactgtgtggcagtccatccatctgtcagcagccactgcgggcctacttgctggrtgcccagcaccgcactcaccactgcaggcgtggccaggagcgtgagatccccagagcccatggccagtgagaggcggccagggataggtacccagggwatgccacaggagtttgctgggctcacggagctctttcactggtcagagaggagtgtgtgtaggagrggacttctacttggtgttgaaggacagatggggtttggctgggagagaggaggaatgtgggcgggccttataggcaggcgagaaggtgagagccaaggccctctgtgggcagggcgaggtggcgtgttgaggagactcgtccagctgggcagaggctcatgttgagggatgaggcagagctgggggaggagggagcccagaaatggcaggtccttgaatgcaggtttggaagcagggacgccctgtgagggtacagagtctgggctgttaccttctgtggcttttgctagaaggtgagatgtcagggaggaagacaggactccaggatgtctcctgtctctctctggaaaaaggaggtgggcccctttctcagcagtcagctgctgtttttgaggtcttctccatggataatccacggtgttggaagtggttaaggtaatggatcctcatgggcttaccataaaaatatctggaggctggaccattttccttaaaaygttataaaagctggaattgaatgccatcggtgtcacccctgggaagtgtgctttctcttgagctcttttggccccragatagcagtcactccatagtttcgtgaagaccagcctggtgttgcctggttttctgccattagggagcagctagaggtcttccagtagctcctgtgtaaagtgatgaaagaaaagggctgggtgctgmctgctcctggagaaaagcaacacactcccaragtcttaattgcctgcttccagggagctgtggtggtttcccttgggcagggcacacgccccagtggttgacttaataaggatacattttaatcagaggacaaaaatgtgccctgacttgatttccgcatgggcttccagcatggtcaaagggcagagattctctgttcagctgaacagatgtctattgagagatgccagacactgtggagcttgcagagataaataaaatgtcgtcctgcttcctggtcagaggtgggtgcatgggtgagtggtggattcaggttgaagttcattgcagctggagtggygggartggagggcaatgtgaggtgagtttgggtttggagcctggaaggccttgaatgcagtgagtttggacattattcattgacagtggggagtcatggaagagatttgaggaggagcaaaatgttcagaccagaactgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggacyggttgctgggtgaggtaaacacargtggcaaagcaggttgagagaggggtgattcagtcttggggatggtgggggaggggcwgtrtccagacacctgagtggaggccaycaggaagaaccaggagtctaggacaggtgaggtctgagatgcagagggttcagatggcaaatcatttggacaaagtcattggctttggcaagggagaaatgatagstttgttcattgatccctttatccactcatcatttagaagcaagattgagcaacttctttgtgacagtgccttcaacagctttttaaacagamgagtgtcaggacctgacatgtgtctgtaggagagaccggggtaggagatgggggtggacagtgggcacaggagagcagtcgaaagtgaagctaggaccagggcaagggggccaagtaaggctggtcagtgtcaagccaaccaggggagggtggcaacgtgaaagcaacaaaggagagcaaccacaaaatgtggcacgaaagttgacaaatgctcrccatgggaagacaaagcaggcagtaataacatctgtaccagagagaggccaggagggcggggagagatcactggagtggctgaagagaaggtcaccaaggagcttccctagaacggcttcaactgagggttgtggggatggccagagagcagtctgaggagcaagggcagacgctgttccaggaacrttggcagcatggggacacgggaaggaaatgcggttactcgagaaggaaggagggcctctcttcatccccatcctccttcccttcccatcctttccttttttaagggttagactagaaggattcgaatctatctgtaggcctagttgggcrgctgtagtagaaaagagkaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgcwgggatcttgaggggttgcctttttaaaatttttttattttttgagacagagtctctctctgtcgcccaggctggagtgcagtggcatgatctcggctcactgtaacctccacctcccaggttcaagcaattctcctgcctcagtctcctgagtagttgggatacaggtgcatgtcaccaaatttggctaatttttatatttttagtagagamggggttttaccctgttggccaggctggtctcaaactcctgacctcaagtgatccgcccacctcggcctcccaaagtgctgggattaccggcatgagccactgcacccgtcctggagaggctgccttttggtagaagtaatgcaagcctcttttaatatgggcacctgctcagatgtgggtgacctgatggttgatgacaaaaaaatgaccatattacttttcagaggtgaaaataacagctgtagctgtgggaaagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttmatttttaactttttgtagagatggggcctcactgtgttgcctagggtggtcttgaactccagggttcaagtgatcctccctcctaggtctcccaaagtgctgggattacaggtgcgagccactgcacctgacytggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaataggccaataaaattaaataactgtaaagaacgctatttaaatatgtgtggtatgtataagtggatggttttcatccacaataaaagtttatattaatgttttgaaaagagagagtaaagcagtgagcaggagtaagggcccgggggaggtcacagggagcagaaggttgcagatggggagagacaggtggcttctctgcagcctttgttcctcatgtgggagagggtagcaggtggcttccagattttctgcctacaaatgtctgtaacaaacaagtcctagctgatcatggttcctagtgtttaaaaggtatgaaggagggaaggggatgctggtggtgggtgatgatggtacagttaacatgtaccagttccttgatgtatgcactaggtaccatgctaagcactttagatgtatggtcatggaatcctcacaagtcttcaaggtagatggtgtcatcctcatttcaaagatgagaacacaaaggttcggagcagttgaygcgttgcccaaggtcacacagcaagagcaaagcagaaccagtccttgaacgaggtctgccagagcccggggcctgttctcagctgccagcttgggataaggccaaacagctctatcccaaggagggagaaggaaaccagtgtttggctgttggaggcagaagtccaaggtagtgaaaagtggccccgaggctagagtcccacaggaagaagcctcttcccagcctgcaggctctcccctaggcagttcagtggccggcttccaggacaactcaactgtgttccctcctgaatcggaagagcgcaggcaaaagccttggcagctgtcttgccgcctgggcagaagcccagattgccaggagtcaggctctgttcggtctgtcctcttgccccaaggaggtgacagactaggcttggggtgtcatgtacatgggaaaagaggacaaagtggtgagttaaatcagctagtctgtagcaaggcatgtttccccagggactcaggtccccgcttcaagagaacctgttctggagaccccttccttgactgtgtctgctgtgctgggctgggacttagtggacagagacagcagcctgtaagccccttttcccaagtaaggagcaagggcacattgacatagaagcaagctgacatttcccaagggacgtaggaagtgcctgcacttcatgttttcagatgagtctgcaaaggaaaacagcagtggtacttcatcactcatccattcgataaatattggttagtaattacatgctaggtactgtgctgcatagaaatggccctcgaggaggaaagtgtatgaactgctgcccacaggatccatggatgcttctgaggggtgtgggagggtaacaggggagggagccagtgtccagctcctagagcaacctccccccaactccccccaattcaccattttacagatgaagaaacaggctcggccaggcgcctataatcctgacactttgggaggctgaggcgggcagatcacaggtcaggagttcgagatcagccttgccaacacagtgaaaccccatctctactaaaaatacacacaaaaaaaattagtcgagtgtggtggtgggcgcctgtagtcccagctacctgggaagctgaggcaggagagtcccttgaacctgggaggcagagcttgcagtgagcygagatcgcgccactgcactccagcctgagcgacagagcgagactctgtctcaaaaaaaaaaaaagaaagaaagaaaaaagaaacaggctcaacaacattaagtgatttgcccagccaccgcattgaataagtaggcagattttcagagcaggcctgcgtggctgcactcttggccactatctattactgatgcccacctgtgtgtttgcttccagttcttcaaggcctttaccaagaacggctcrggagcagtatttccaggtgggtgcccagctctggttgtcctgttagcatcttcctcccccaacctccctcttcacctgggtttctattggggtggagaaagccctggcagtcggcagggtcgagggtgaggcggtccccacgggaagcctaacttgtgtcttcccaaaactatcctcccagtcagctttagggaaaggcaggatgaagaagcccttcaggttggacatatccagggccctagggtcggggcaggggcaccatgttcccagaagagctcttctgtcacaatggggttggcgcccagagagcagaccagagcccttggggaaagtcctgacgactcccagttctgagggattctttcctgtctgagggatgggtgtccttgcactacttggggccacaggaggactactcaagccccattcttctagcacagggaaggactgacgcctcgtctgtctctgtcagagctggctgtgccctcggccctttgtttctgggagtgaaggtggccagtgtgcygtggaagcagctctgctctcctgacactccgctcacgcctgttttcatttacagtggctggtgctgacgtgcagacrctgcgggagaggctcattgacgccctggagtcccatcatgacacgtggcccccagcctgtcccccactggagcctgccaagtactttgggctggggcaggcttagtgcattgtgggccaggatcccaggcctgggagtgagagggtggtgggaacagcagggcggggaccccagtttattttccttgctgcctttgcctgtggggctcacacaccagtctgctggagctactccagaaccaagtggcagctgatggctggtggtgggcttcctatcgcacaggtcctgctgaagagccctgtttttctggggctgactgatggtgcaagggtccatcccaccaggtgggaaggaaaagatggatggggcttctccaggttgtacctgctgctgtttcttgctaccttccctcaaaatgtttgcgggacgcagcaggatttcacatgctctatccccrggaaggccactgagagtcagaatggcatgaggaggaaaaaggagatcaaatattttgagggaamytggggggaggtggagagaaggtggtcatgcctggggcatgggggtggcccctggctctctgtatggcagagcatcaggtgcagtggccrgtgctctgtatctgtcagccaggcaagcttcccagcttgcctcttttccaggaaaatgaagacagtaagktgcatggtcttgcccatactttcccaaagaagagacagctagattaaaaacactaggccccccacttctggatcagaactcaagataggataatgcccacctcggaggactcttgccaagaaggaacaaatccatgtaccagcaggagctgctagagggagcccagccttgtacacagtggaggccccaggtgctaagraggcctcacraggccgctgttggtgcgcagaggctctcttaaaagtttgtgtgcaggtgctctcagagacatggccctgctgagagattgtgtttccaagtgtcagttggggttgaatccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgactgtgtttccatctccctccttacacacacacgtacatcctcatggcacattttcagccctggggtatctcaaaagcaacagctcaagcaatcctgccaaggtctctcaaagtgatcyttttttttttttttttttggaagacagaatctcgctctgttgcccaggctgggagtgcagcggcacgatcttggctcactgcaacctccacctcctgggttcaagcaattctgccgcctcagcctcccgagtagctgggactacaggcgcctgccaccaagcctggctaattttttgtatttttagtagagatggggtttcaccatgttgcccagggtggtctcaaacwcctcagctcargcaatcsgcctgccttggcctcccaaagtactgggattacaggcataagccactgcacccagcccaaagcaatccttttaaagaactttargaaggaggtagagatgtgtgatgaaaggtgagctgcctcttctgaagtctgarggtgggagtggggaaaggggtactggcccccatgtaggttgtgctcttctgccagcctagggaagacccagggaagaggtctgagaggctggccacctgatgccaccctaaaggctcaacacctcttttcctccaccccagcggggtgcactctggccctcacctgtctagcatatccatttggactgtcactggctgggctccagcatcaataccatgtttttgtttgttttgttttgttttggatatgttttgttttgttttggaaactgggcctcagtttcctcatcttaaaataaggagattgggttagagatatagatggcttctaaggtctcctgaacccaaggctttctgattctttcattgctttttaatgcctgctctagggaggaaggagcacatctcccccttggtcgtgacttgtcacagttccagacttatagctgttgggttctaataccccccagctctcaggggaccaataaaaaccacatccagtcagcctgggcctgccccagcacatggagacaactggtctcaaagcagcccttcccagtccccctccccacacggcctcctacccacttccgactctttttgtttgtttgtttgttttttggagacggagttttgctcttgtagcccaggctggagtgcaatggtgcaatcccagctcactgcaacctccactccccgggttcaagtgattctcctgcctcagctgggattacaggtkcccgccaccacacccagctaaattttgtatttttagtagagacgggctttcaccatgttggccaggctggtctcgaactccagacctcaggtgatccacccgcctcagcctcccaaagtgttgggattacaggcgtgagccaccgcacccggcccactcctgacttttaaaaagagacaggaagcaaaaacaaaaccaagcacccaaggtaggtcagatgaagagccagggttagataacaagagcaacatcctttgagactaaaggtttggttgactcccttggagggccctgtgtggaagcggaggagggcgggatggccatacctgcagcactgcatcaccagcgtctggcgttgccagmggttttgtcttatttctgctggctgtgcagagtgactgccagaattgtctcttgcaggctggaggagattgatggattctttgcgagaaataacgaagagtacctggctctgatctttgaaaagggaggctcctacctggstagagaggtgagctgccctgaagttccctgcaattcttggatagccatggagagagagccccagtttgggagcagggcttttcctgccaattctagggtcttggctgcctgggtcttttagcctggcattggcctgacccctgctgggagccatgggaagtgcaggagctggacctttgcgtttcaaaaccttgctgtttattcttatctccttcacggaaatcaaatataacacctgctgttattgagcattggaccagattgctgacacacgtagctgctaatccccaaaattaatgaaggtgatcaaatagcatgcccaagatcacacagctagtaagttggtagaagrgggctttgaaccaggtccgtctggctccaaagccaatgttgtttccacagtgtcccactccatgggactggagtgaaatatttgggagggagggaacattagcgacgccctagccccaccggaggaaatggggtcctttacccagatgccggtctgtctcatgtggggcatccgtgagccagctccccagcgcttccagctgcagtgccctgtctagaaagcagggatgattacgtttctccgtagtattgttgggaaggtcaaatgcagcagtttatgtaaagggcctggattgcagctgacacatagtaggtgctttataaggatccattcccctcgcctaatgcagagagctcaccaytctgccrttggttcatggacttctccatagaccagttgtgagcttttcccagctgcaaaggtgggacgtgccagtgcacgggagatactccaagtcagtgcagggagacaggcatgagagtaggcatgaaattaaactgcactgtcagcctgagtgattttcctgctgaaactcaacaagcacagctgagagtctgagctgaagccagatgctgtctccaggcctctcagccctgagagaggaggcacaggggttggggaggggaaagacagcttggcttaaggagtgcctgaccctctggggtcccagttcatgcctggggtcatgcctgttatgtagaggtgataaatggtgattggaatcaggtcttttccctcccctcccaccacagtccttgagtaccaaggggctggggtcccagtggttggagccaagtgccccatgcccatgcagtggtgcttagcgtgggaccagtggctaagggcccaggttctggagccacactaagctgggatttgtagcacagttcaggcatatgcaagctgtgtgatctggaggcatgatttcacttctaagcctcagtttctccagctacaagataggagctttatatttatttatttattttgatttttgtgagacggagtttcactcttgttgcccaggctggagtgcaatggcactgtcttggctcgctgcaacctccacctcccaggttcaagcatttctccttcctcascctcccaattagctgggattacaggcatgcaccaccatgcctggctaattttgtattttcagtagagacgtggtttcaccattttggtcaggctggtctcaaactcctgacctcaggagatcygcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagkagagacggggtttcaccatgttggkaaggatggtcttgatctcctgaccttgtgatctgaccaccttggcctcccaaaatgctggaattacaggtgtgagccaccacgcccggcctgggagctttatttttaagtaaacacttaygtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaataatgatgactgatgtatatttttctgattcggagtctagataggaagctttataaatataagaaaaaaggctagggggcgccacctgctccatggtgaagagtgagacgtcagtaacagaagtccgtgcctgccatttgcagatggcctgtccgattatgctcagaacttctcttcccatttctaatgtggggacattgtcatctcaacaaggcctcttgttgccttcagagagccccacgttaagaaacgttttcagatcttcttataactatacacattgaccaaagggcccctctgactactgcacatactgggctcagagttagcctgctgtttagaagtttacccaattccaaaggtttattttgtttgtatcctacccatgaaatttgttaccatatgtatttgaacgcaataaaatcacagttctttaaacatctgtgactcaagcttccataaggaagactgctcttgcccccaacaattgatatttcaaacaaacaataattagtaatttctaaagggatcttttccctttagaaaaatgttatgagaaggccctggggaatcctggacatcagagrgcagtcttggggtgtgaaggtcttaaagacaagaacgtgctggctcagtgcaaaaaacaaacgagaattaaaatgaaaccacattttattgtgctctttacaaattgctttcattagaaagaaaatgctacccagttgggactgtcgtaagaaattaaagcgtgtgtggcatgcacagctccaaggcctctcctcctgggcagtgattggcacttgctacctactggttagctgctgttgatggcgagtatctcttgcgcatcagtgtggtccactctttgtgggtttagagtctggaaggagcacagctgccatctgggtgccttcacaggtcaccgagctgggacccagccctggctccctccacccggtggcctggcccccagatgttctgctgtccctgcaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtcccygtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagwcctcaaaggcctcagccccccgcacccagtgtcgcctgcaccctcattacgtccccaccacagccctggccctcttcyccaccctcttctgttcgcaggcagactcattggcaggctacaggcctggcaagcactcgtatatgcctgaccctccctccctttggttttctaattgcagaaaagttcattagcagccagacaatagccagttccaaaatgccgagagaaaacaatcaggccagcctcagcccctctgccaggctcctgctgctgaatggcccgttaatggcaccagatggtgccttggtgccctccctgggcagatgattgatgtcagccaggccccgcaggcaggagcattgggccagggaggcaaggcttgcctgtggtgcctggtgagctgctcctcggggccctcagtgccgacccacacggcgccgggcagggtggccacttggcctcaccctggcccagatcacctgctagagggcccaggaggtgcgatgccaccaaggacagggaggcactcgctttccgggcaggcccagaaagtgccagtgatggtggggagagaargcattgtctcctcyctcsgagttggtggaggggaaaattgtttgtgacgatgctgcctccmgagccatctgctcaccgagaaacccaggatggtggagtggaatgaagccgtgcgtcccatgccagctcccccggggcagccctcacgctgctgctggacccggcgtctctctctgcaggtgccctggctgtgggtgagagggaatatgcactcaggaggtatcccgtgccctggaggactcctccctgtcggaaaaaagaaagaaacccaaaaagaccgtaaaaagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggggtccttggggaagggagtcacactccgccgttcctgtctgtgggcaccgggctgtccygtgcctttccatgccctgcctggagccagagggccactgggggaattctygggcccarttgccttaccaggtgaggtttgacatcaggctggtgtcagagaggctttccagagcatgtgcagtgattagaagggttacagygaggcctgggtgccgtcttctggcctcacagaggacaagatggaatctcgttcacatatttaataaaccttcctgtccgatgagccacccttcttcctcttctgacattggttagctctaatcttgttctctgcacttactgcctctcctccctggttctgtgccctcacaggctcatggaatccakgtccttctataccgcttacctgcagagactctctgggctcaccagggaggctgcccagaccacagttgcaccaaccactgctaacaagatagctcccactgtttggaaattgkcagatcggtaaggctacgcctggttctcctcacttcttctccttcctctgatcacagaccaccacaccttcacacccacgccctcttgctcattcttcttccttgtcatatgattagtgtgtacattctgagccaggctgtcccccaccctggggtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactyactatgtgctaggcactgtggcagcagatatgtacaggcagatgcattctctgcttgtgcagaccctacagcatacrgcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattrtgaatgatcatcataatcattcgatcattacagttatgcaaaccattgacgttcttgtaatagcttgggctggtgtatgtgccaggctctgtgctgggcaccttccctrtgttacctcattcagtcatggggccacttctggaggcagggcacaggaatggagaggtaaactgaggcccaaggacascaaagtggaacacagaggagaccttgccctgaggaggagcataggcagccacaatgcgtaccccattagttgaccttattggctctttccaacctcaggaggttgtcatggaggggtcaggagcaagtcatgtgttttacaggtgagctgactgaggcccaggaaagtcaactgagttgcccaagctcacaaactagctcacagtcaaactgaggtcagaacccaggtctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagmcttggtgggcagctaaaccctggtctttcagagagggcccagtttttccagagccatgtcrtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaatttacccaaggtcacacagcacatttctggcagaagccagtggtaacttacaagactctgtgaccatcagcagtgccccttctcttctctccctttagccctggatgctccttgcagcccctgcaccatggtyaatacttctttctctctctatctccctctgggtcctcagctccaagatctacatggctgacctggaatctgcactgcactacatcctgcggatagaagtgggcaggttcccggtcctggaagggcagcgcctggtggccctgaaaaagtttgtggcagtgctggccaaggtgagcagggccatggcttcccttgtctgtgcaattctacggatggtcagtgtgcgttsctgtaagctgggcaccccgtcagcccctccctccagaagcccatggtctggctggacacctggacccacagctctccctgtccaccataggtgataccctccagcctcagccataccccacaccagccccacactgccagggacaaccctgccccatgcagcagtgtgggtgggacacagggcccgtgccccccacctggggatatttccagctgattcagtgactgtggctctgcctgcctgagtcctcagtcagagccccagtgtggcttcccacccctttctgtggtcactgggaaagcaggacccctaggacaccctggcgaaggagaggatgctcttctgatactccttgcttccctcccagtctgacccgatccctggccctggccatgccttccttattcctttatagtttccccgggaaggtggctactccacgaagggtagctcctatttattgaggacttgatgtttgtctaggatttaatccttttaactactctgcgaggtgggtggtttattttgtcctccccgatttaagaggcccagggagctcaagtgccatgccttcgttctgccagcctgaaagtgttgtggtcaggccttgagcctgtgctccttcctctctgaaggtgagaggtggctgccattccctctctgcgcccttccctttggttccagatcctggccattgcgtccctgctggaaaccctggactctgctgctcagtactgctgagtcagatgtggctctgggcgcttcgggtttggccgctggctcagcctcccttggccctggggccyggatctgagcccaccctcctcagtgtgggtctgcaggaagctggggctgccctcgggtgatttgtgcytctccttgggaacttcctgccagcctgatscctccttcccacctccctgtcctggccccctggcttggtcacatgaatgcgtggtgacactgagaggrcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaackgacccacgtacagtccctcctcctgacccatgagggagagcacccagcatgctttcccggcatgcctcagacaccccaccaccctagtccagtactctccaaaggagtcaccccaggaagatyggcttgtgtgtcactcgcatctctcagctgtgmtcaaayctgctattttctttgtccccagtggggctgtttgcagccggtatgggggaaaagaatgagatacagaaaagtccctgagctgggcagaggcatcacccsctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggggcatgggcctggagaccctctgtttgggttttgcccgcacatcccctggggtctgtagagtattctggcccttgccttgcttgggtagcttcttcctgaatagtagtatcctagcagctaycatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacscctaagggtgccagtggacactgctggctccccctggctagctgccagccctgcaggtgcccggtcagtcaggaggccctctgcatgtcctgccggtgccttcccacccrgcctctcccagcctgtgctccctcctgtgagcagctggtaggagtggccactgggtggcgtgtgggcaccagggtttccttgctcccagttgtccagagctccttaattcatccatcyttctggcactgtcgccttagaaggcrgaagtttctaagtcaggatgatggcaaaggtcagtgagaaatgctgacttcaagctgtaaatttgtgtgtgagttccagaggcccgtgtgggctcaccaggagggcacgtgtcaaagcgtggtcttttcyggccatttctcactctgggggaaggtgtccagcccaacgtttgataggaatatttaatggctttctcagaggaatggatctgttagcaggttttcctgttcagttaccattcgtgtctccagtatccttctcctctcaaatgtttgtctttgctttctttgctgtgaktttctcagggtcctcatcccctcggccagcctctttgtggttttatctgaycagcctgctgctgtgyccctctttctcctgccctccgccccttgtgctgtgcacgtgcacacacgcacacacacacacatacacacatatgtcctcctccctggagtccttgtggttttaaagtgctgatactaatcggatttgagttgacttattgtcagagtagcttttcatgctcctcagataccactgggagttaccatcaagatctggatcttggctgtgagcccctggcctggctggtcctcactggcagcccatggaatccaaatgaaaggtctcgtgcccacctaacccagctggccagtcagttggcaagtcagctctatccgaggaccacccaaagacaggactgtgtggcccagggctcccagcagccctggcaaggggcacaagtgctccagccttcctcccagtggtggcacatggtcggggggtgctgcacaggagcctgaggtctgagagagggagacttccaggaccccaccccatttagagcgagcaccttccctaccctgtcttctagccttaccaggtgtcccagagcaaargtagtacagaagtcatatttgtgtcttakttagaatgttttcctggtggttttggaactttgcacaacctcctccccactgccccccgcccccygccccccgccttcttctgcatagcttcctaccatctgcaggacggggaacttggggaattgcttttcactctccagcttcygcttgttcctccccacagtatttccctggccggcccttagtccagaacttcctgcactccgtgaatgaatggctcaagaggcagaagagaaataaaattccctacagtttctttaaaactgccctggacgacaggaaagaggtgagtctgggaagcaaataaagatctctccatcctccgtatttatgagagtgcaaggggttaaccctgtcatttctgaccttcttcgccagtttgcaccagggagtcagtgatcttsgttgggtcctaacaataatcaataaatgactattgattgagctctytatgcgcacatctcatttaatcctcataatgttagtggaaggtagatattctccccatttagcagatgaagaaacagtactttgaaaaggttaagcaacttgtctgggttcatggagccagtaagtgtttgggctgggatgaaaacttggtgagaccccagagtttttaacaactaccctgtgctgcctcttagtttgtggtgctgctcagcatggcctccctggccctctccagggcaccttctgggctcctgctcatgctgctatttgcaaaagtgggtcactgcagccagcagaggtgtaaaaccctgtagacttgtagggtgtcaaatctcgaagggacctcagagataacccccttgtgttacagctggggaagttgaggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccrcatttccggggctttccctgctccctgtgggtyctyttccacttcttgactgtgcaggcagctcggcaaaatgtagaccactcacaggaagcaggtacgtccaggasccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaycaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttacatagctgatacatagcaggtgctttgagcaattttattgcacttcccactgaaaaacaatttcctgggggaagttggggaaacacgtttcccctgctgcctcggattgtccacaaactgcaccaccatgttctcyggccacgctgccccacacctgcttttgaagactgaaaggatgcgcatccaattcagtccacactgattgaggaaccaggtttataccaggctgcggcttggcttggaggatagatacatgggtgaaaagggcgacagtgcccgctcttggtggacctctagtgtgaggcagggggacagagaggcctgcagtgcatcagggctagggccgtggtggagagaaagatgtggggtgaagagagggcaggctsgacgccattgggaaggggycygaggccttacggggtgagttgaggggtgatgggtgagtagggattccgccaggagaggagcatcccagcagagggagcagcctgtgtggagccccgtgaatcagaggaactgccaggcagtggtgtgggaagccagtgtgtatggagcatctccaccatgccatgtggcgctgcaggtgccggggacacagcagcatatgagacaggtccctgcccccacagggccagtatctgagtggcaggagacagacacagagggatggcttcagccatgatgacgaatgctgaggaagacaaagcaaagcagtgccggagcgggtgctgtctggagaggggtctgggaaaggcttccctgtggagggcccggtgctgggacccatgtggagaggagaaggcagtgtgggacgtctgggaagagagtctcccaggctgtgttggtgtccttgggctgcactcacaaatgtcaggctggggctcagccagtagaygtctgttgtctgagttctggaggctgaagtgcaaggtggaggtgtckgtgctggtttcttcgagcctctccttggctgggcggtggtcgtcttctccttgtgtctccgtgcagttgtccctctcccaatccatgtccaaatttcctcttcctgcaaggacaccagtcctattggwttwgggcccaccctaatgaccttattttaccttcattacctctttaaagaccctgtctccaaatacggccacattctgagaggctggggattagggcttcaacataggaatttkgggggacataattcagcccatagcacaggctggagaccagcaggtgcaaaggacaagcctggtgtgtgggcagcactgaaagaaggctgctgtggccggagggagggaggtgaggctgcagagacaggccgggggcggaggtgagcgctcrtgggctcagaggccttggcgagggcagggtttggaggttggtgttggcattttgagaagccactggagaggctaacggaagtgacagttggttaacactttagaaaggtggaggatgggctactgcaggcagggggaggcagggcagctgaggagcaagctgcatgctcgcccagcagtggtggtygggcctggactagggttgtcagtgtgcccctggaggaagtggtcagatttggggatatgttaaaggcagagctgagggacttactgatagattggaggaagggtatgtgggaagcaggactcgggtggactccagggttgtggggcctgagcctctggtggatgatggtcccataagctgaggagtcaggggctcgggttgggatggtggaatcaatggcccgctttgtgtcaatagacctcccaatggaggtgtgcacagttgagtctggagttccagggagaggtggggaatagagagattagctttatagtcattagtagcatcagagctcaagctgtgggactggatgagctccctggcagggaggtagagaagagtgctgaggactgaatcctgagcatcaaaccaccagcaaaggaggctgaacgggggaggccatggtgatttcaagggggccccagagtccagtgtttcaagatagaggtgtagtcactggggccagtgcagctggaggtggcgcaagatgaggacatctctagcaagggctgtgtcggtggagtagtggaggtaatggccttgttggattcggctgaagagagaccaggaggcaagattctggagataatgagcaggaactggggcatgactgggttagagggaacttctttatsatcatccttttccccagttggaatgatcccttatcaggggataaatggatgacgcagtaaagaaaaaacaytaacgggagtgaaatcctggaggtgaggagtggggtaacccgagcagcagcggagacagaggctgagcaacgccagggccgtgtggtgaggccttgtggtggggaggtgggcacctgtgctgggtgcagaagaacaagctgagaaggcagaggagagagagagaggcaggtgtgggctgctgcgggtctcrccttgccaggagtgaggagagtagggtgccaacgtcctgctgcgtggaggggtaaaagcaggagattggcttctaaaggcctgggaggtttgcggtaggaaggagcgagcttggaggcaagcaccagcagccctggagcctgagggtgaagggcttaggaggggcgtgttggattaggagtggtgtcctcagcggggagcctggtttcagttagagcaagaaagtggggctggttaacaggtctttgctgatgccagtccagagggtccagtgggtgggagggggtggggggaatggaaggggagagcgaggagagatggagacagattaggaagggcatgtgcaggccaggtccaggcccgagggaggtgacgcatggtggaagcaagtcggacaggcagcatgagtgggcaggggaggaagggccaggggctagggcggtggccctctggcccctgctgacctctctcaccatgtcacaaagagcctgagtttcctgccaaggagtgtggactttgtcctgggtgtgagtgacaggcacccaggttagtggcagggaaggggatccaggtttaggagttttggggggatggggtctcctgtaaagtgaccatggcaggtagagaagtagacaaggggacactgggcctctgctggcataggctggggtgtgtggcacctgtgcaggggtggccacggcaggatggggggcggcagggtggcctggggaggcaacggctgtggggctggcagcctgaagggctggtgcgtggcatctcctctgccctgtagccaaggccaaggaggtcctcccagccatccgaggctacgtgcrctacttcttcggctgccgagactgcgctagccacttcgagcagatggctgctgcctccatgcaccgggtggggagtcccaacgccgctgtcctctggctctggtctagccacaacagggtcaatgctcgccttgcaggtaaggaaggaccatccccaaggctggagtcacttgtgggggacgagggggtgaggatacttgggagtcttaggccaaaatttggggaagggacactcattgtcccctcagtcacagcccaggcctgttaaccaatgccagtatcatcagccccatttttgacatgaggaagccaaggctttgacactgtaagaccctggtcttcccatgccgttgctcactttttccctgctctagggcccctctctagcctactggggtccctctcccgcctcccctgctccgtcttctggctgttggccccttactcaaactgctagggcagagggagctggggttctctctccctgggaagggtctgatgagagaaggggctggaggagaccaggtcrttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccggkgkggggagaccagggcggagccgaggttaaaggagctgaatggagcaggtggtggtgcargcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaactcaaaattaccaggcacaagctgagagccccctccacaaggcctgatcactatgactcatgactggacccttgactctgcttgttgtcccctccccaaartaaccattctgacttgcatgccacttgctgttgctgctcctgcttccttgtagtcaacaacttgtccccctattaaaacytttaggagaagtgcttctacagaagggatgggctgatgcattccctgggcaacactgcgtgaggggctggtggccgtggctcaccctctgggactcatccagaggctgcctagagggctgggcccacctggggtaccaacagcstgcagccccagcagcatcctgactcttccaagtacccctcaggtctccccccaactatcccttggagcccacccctaccccagagggctgctgctgggtaaaagcaaggattgccatgagcagctgcctcttgcttgaaaacgcattttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcrggacagtgggtctggccaacaccgggaaatgactgagatggcgctcttcacgcttccctggaaaaccacggagggccggggctgaggggtaggtggatctgcctcctcctccwtgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttycctctgtaggtgmccccagcgaggacccccagttccccaaggtgcagtggccaccccgtgaactttgttctgcctgccacaatgaacgcctggatgtgcccgtgtgggacgtggaarccaccctcaacttcctcaaggcccacttctccccaagcaacatcatcctggacttccctgcagctgggtcagctgcccggagggatgtgcagaatgtggcagcmgccccagagctggcgatgggagccctggagctggaaagccggaattcaactctggaccctgggaagcctgagatgatgaagtcccccacamacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgmagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccrgacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgcttycacttccccccattgagctctgctccctytgagcctggtcttttgtccttttttattttggtctccaagatgaatgctcatctttggagggtgccaggtaraagctagggaggggagtgtcttctctctccaggtttymccttccagtgtgcaraagttaraagggtctggcgggggyagtgccttacacatgcttgattcccmcgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcstcagtgccctgggctggtgagggagragcctgtctgcacctgcctaattccagctcctccaggaagcaagggcttgtttgtcagagctgcagggttggccactcggtggggaggagtcagccaggattagagagcctgcccctaatccggcctgmtgggttttacaaggatcagagctgctgataatgaacctcattaagggggagcaggagcctcaatccgatttggtyttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcmcagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcytctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatccycttgtccccatgtgtcattggagataaactacccacytaccagattgttgtaccatgctgggcaaacactaagtrcttaataatggtagcccactgctcatgtcgtgtcgtctcctgtcttgatacctgaaaactcaaggggccctgttgtgcttggaggggggtgccgttcccacaggatattctgtgaagggtgtccctggagctgggyctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctcccaaatggtgagaggtagatccaggacttgaccccagatcccacccactcaaccctggagctgcagtctctaccccttctaacacatgtgattytgtttcatgtcctgttccatcggtagagttacacactttcctgagactttatatggtggtgctgctgggtgccagcccttcttccctccaacagtggcartaaccactgttgtgtgttggtgtcaaggagtggggacaccctgaaggaatccgccttttctagagctctcgctccattccctacatcgaggctgaagtgccctgtctcgggtccttgtttttaggcctcgtttgaaggaggggaagaaaccaggttcgttgggcgtgaccttggctcagctcgtctgtgaaattggggccgcagacttagtttgcgggtccctgctaaattcctctccctcttcctgggattcccatccatgtattgccagctacatgtagagtggagaggagaggtttttcctgcagggcyttccagagaaaggattcttggccagaggaaatcacagcctataagatcaatatcctgatagaatcccgggccaggtgtgagaggggagagctcactcacaccagcctgacagtcttggggcagagcgccccataggcctctgcagccccatcactgcctcattctccctcaggtgccaaggaagctccagggtgggcccagtatccttccacagcatccctcctcttccccttcaacacccctttcacccctccctccaccacctctgaaaggtgctccttgggcagggcgataggattcccacccctagctttaagaactaaaccaaacttcaagaggagcaatttaatcttcatacctgactccttgtccctcctcaggcatgctgttgtgcaggacagagccctggcttctcctggatgtcacacctggcctgtctctgacccttgctttccctttctctgctgccctcaagggtcattcacacccaagagggtaagaagctgccctctcatcccttcctctcccaccctgggcctctgccctctgcctggccccagcagcacagtcttctccatagagaggggctgggccatgggaccccagttcctggggtctcggtgacacagttcactgtttgctgcagaggaggccccactcgcagccttggcctctgccctgcagaagaattccctgtaactcactcaccartggccgtgggagccagtggcctcggcgagggtcagttggactgcatagctgccggctgagtctctctggccaccctcactggccccatcactccaggttgcactgctgcccagggggtttgtgccaggcctgggtcacagtggaagagagtctggaaatcacaaggcagaggaggagacctytgccaatgtgagagaacaaagttaaggggcagtccatgggggcattgaccttacttaggtgaggaggactcagggaacatctacagactctagggctagggtgagatcctcctgatagtgctggtagctccagctgctgctttggcaagacttggtcgtctctatactgagagagcaaaagctcttttcctggggctgcatgttcttccataggaaagtgggcttcaggtgctgcctattaaacctcctgcctcccctgctgcagtgctttgatgcctttcacctgtgtctacctgcgaacctctgcccaccacggaagagcagctcacatttggaaggggctaaaatttttacctagtttgaatctgctctgcaatgtccccatcaagttcttaaccatcccgggttccartggttacagagttctgccctggggagggaggaattgcttagcaaatgatgttgagaatagtgattatttgggggaaaattcaggtaagatctcaccttcataccatataccaaaatacatctcagtagattagtaagctaatgcaaaaaaaaaaaaaaaaaggggaaatataattgaatacttcactgtttttgaaagcatgaaaacaatggaaaatgcaactgatgtgagtaatccatctacttgacgtcacttttaagaaatarggccaggcacggtggctcacgcttgtaatcctagcactttgggaggccgaggtgggtggatcacgaggtcaggagtttgagaccagcttggccaacatggtgaaacccccatctctactaaaatattacacaggcattgtggcacacatctgtaatcccagctactcaggaggctgaggcaggagaatcacttgaacctgggaggtggaggttgcagtgagctgagatcgcgccattgcactccagcctgggggacagagcgagactctgtctcaaaaaaataaaaaaataaaaataaaaaaataaagtaaagctacatatttaaaagctggggaaatayatgctgtaaatatgacaaagggctgtgactcttctgcaacacaccattttaagaatgagctaggtctgcatttattgacctgataaaatgtcccaagaaggacacatttttataaacataagttactattgttatatatatgctaacgtttgtctagaaaaagtctagaaaaatacacactgaactgtgaatagcagttatatttagaaagcaacattaggatkracttaagtcagggctyggactagagcaaggcaagtgaggtgccaggatgcaaaagttaaggagacacctgacctcaggggcccacaactgcagagcccctgacagtgagtgtctcagtagcctcgccctagtcctggctttcacttaaatatgttttcgaatgtttgtaataaaatatttcttttggaaggcaaaaatagcaaggaraataaataggattaaaggatactaaagcccattcartaaaatttgtaggaggccactgatttggcctaggctcctatgatgtaaccaacagaccaaaccaatatggagtcattcatgctaaatgaaactagttaggagtatattcatataacaagtggctaagtgtcagttacagcctctgagctttagtcaattgtaggtggtcaatagattcagataaggcaatccagttaaactgtatatcccacttgctgttttctgtccctaaattctctctgagtacactgcagccctgaagttctttgaacctgttctgggttctgagggctgtccaattactgaatcatacataaaagccaagtaagattttaaaatttgttataattttggtttttaacaacttctgttgtaaataataaaagcmctaaatccctactgaaaataaagggcctaaagactgaatgagagatgcaattttttttggctaacctattggcaaagaaatgatgatgatgatgatgatgatacctagtgttgctggagtgaggggaaatgagatgtatcagttatccattgctatgtgacagccactcccagacttaatggtttgaaacaacagtcactcattttgctcatgaattggtaacatgatcagagctcagcagaaaacagctcctggctgctccgtgcagggtatctaggcacagttcatttggcaagttggtgttggctgctgcctggaagcttagctggggctgtgggaggggcctccagtcctctmcccatgggcctctccatgggctgctcagacttcctcacggcatggtggctgggcycttcagggtggccttttcatgtgctagcctcagaagccacctagcatgacttttgcgattttctgttggttgaggttgatgtaacggctcgcccaggatgcagatagaaaggcctgaacaggttcaaggggaggaaccttgggcttcacctttgacgggtgtgacagagttctggaacactgtgagatggaagatactgttgcagccatcttaagaaactacaatctgcccccgccccagtcctctcatatactgctagtggtagtataaactgatacaagttttgggaaatagataattcataatgtaatgtaattggtaatatacttttaaaagccttaagaaaatatataacctttaatccagcaattctatttctggaatttatcctaaggaagtaattgagaatatttagtaaatatttgctacatgataaatatttatagtatcaaagtaagattaaactaaagtccaaaatgggatattgagtaaattctggtacacaattacaatggaatacaatataacatctaaaaatgatttgagggctgggtgtgttggctcatgcctgtaatctcagcactttgggaggccaaggtgagaagactgcttgagcccagaagctcaaggctgcaatgaccgatgatcactccacttcacagagcgagactctgtctctaaacaataacaaataaatacaaattatttgaatgtatatatttttatcctgaaattattttcacaccacactgttaatggaaaatattgttacaaaaacagttctgtatagtatgatcttattttatttatttattttttatttatttattttgagacggagtctcgcactgtcrcacaggctgtagygcagtggcgtgatctcggctcactgcaagctccgcctcccaggttctcgccattctcctacctcagcctcctgagtagctgggactacaggcgcccgccaccacgcccggctaatttttgtatttttagtagagacagggttttaccgtgttagccaggatggtctcaatctcctgatctcgtgatctgcccgcctcagcctcccaaagtgctgagattacaggcctgagccactgcacccggccaatcttattttttaaaaaagaaaatacatatatttatggatattgaatgcatggatgaaaactaggataaagacaccaaaacattaatagtggttaatggtccctggtgggattatggctgtttgtttttctttttatttatctgtattttctcacctttattaaatatttattagtatataattaaacacttttaatgagccaagaatatgaaccgtcagcttacaaaagaagatatacaaagagcaatacttacgtgaaacagtattctacttgttgaacaataatcaaagaggtgaaagattagtgcgatatcatttttatatagtatgcagcagtacagtttggtactggaaaggtgataatgcaattatactgtatagtatatctgagaaataatatgatgatatgtatcaaccttaaaaagtttatgcccattggttcagttattttagtgttcaaaatctatcctaaggaaataatcagagatattgactagaacttggagcaatctacaaatccaatcagaagacatatctacatgggcccaattcccagggcaagagtcagctgggcccccttcctcacccagggccatagtccgcatctctcccttttgcttcccaatacgaaggccaaggggcaattaccatttatcatcacatttgtgctgttgatttggaagagggaaatatttccctgcactgtgtctctaactgcattttttttttttggcttgtttcctttaggcaggttcttgctctgttgcccaggctggagtgcagtgacacaaacacagttcactgcagcctcaacctcccaggttcaagcactcctcccacctcagccttcagagtagctgggaccacaggtgtgtgccaccacactaggctaattttttttattttttggagagatgggggtctccctgtgttgcccaggctgttcttgaactcctgggctcaagcagtcctcccacctaagcctcccagagtgctgggatgggccatattttaagaaaaatggaaaaaagcattatctatatagaagtgaagcatgttgctatgtatttggtatttaggaagagaacatctatgcctaagaatggacctttacttcactcatttacctcaggggcctgacctatagccatttgagttgtgactcttattttagactcagctgatacatcactccctctggcaa

SEQ ID NO: 13300 - DNA, 28003 bp, Homo sapiens
acgtaggtccctttctgtttacctccatctcctttgccttgctgtttcctgcctccctgttgggctgtaacctccatgaaggggaggatcatgtctgtcttcatcattatatcctgagtgtccaccatggtacatagcacatgctgaatgaatgaatgaatgttctccaccctcgctctttacccaggtcggacatcctccttaactgactcattgkgagctacctaggcctttagatgttgatatagtttggatgttgtccccgcccaagtttcacgttgaattgtaatcctcagtgttggaggtggggtctgataggaggccactgaatcataagggcaaatttctcatggatgctttagcactatctccttggtaccgtcctcatgacagtggagtgagttctcacgagatcaggtcatttaagtgtgttccacctccccactctctctctttcttgctcctgttctggccatgggacacgcctgctcccacttccccttctgccatgattgtaagtttcctgaggcctctccagaagcctagcagatgccagcaccatgcttcctgtacatgcagaaccgtgagctaattaaaccttcttttttttataaattacccaatctcaactatttttatagcaatgtgtgagtggcctaatacgtatgtcatgaacacacaatagttgtgtcagactttgaagtagaagatagaatatcttgtattcttcatcaaaagagacttttacttaaaatgttcacaggtctgagagccatggcaggatcagggcaaatctgtaggagttcaccatcccytgccccttcttcagctggcaggctgaactcagtgctgtggttttggaaccctggcaagtctgaacctaaagtaaagcgtgctgtttggcactcagctgtcaagacaataccttctacaagttggtcaaaggatttctgaggaatgagatttcccagccctctaaggtccctgcagtagcagcccctaattcctagcatcttsgagaaagactagttctcaagaatttgaaacaaagggaaaggtcaggcctttgcaggcatctcagttagcagctctgcctggtgggggtcactgaggtactagggaaagggaagagagaacaggaatatgcatgggagatctgtaaagtaggtgatctaaatttgactgtatgctggtcaatatcatatgacaccataacctctgccttattcattaccggctttcaagcattcagaggtggcttttctgtcacttttgggggaagaatccacataatcctatcacccaaatgttgatccctgttactctgcccccaaccctgcctccctaaaccccttcctctccacgttttaggacgctgtatattccttgttctcttagtccttccaaccacttttcccatattccatgactcttcctcctactccttaaatatgaatactgggttttcctaggatgaagtcttcagtcctcttttctttccccgtctcctcagggaccttactgtaacagtttccatctacaactttatgctgatggctcctcaatggacatctcatccactcactcacattcattcctgacatttcagtagtkattatgggctacatctacaggacttcgatttcaacaggtgcagaacttaattcttcagcttcckcagactggtttccttctaccggtgctcctgtttctatgcaagaattcactgcttatcacatctctgataggtgaccttctagaaacctcctttaagccatccacctccttcccatcctatgtttagtcccaccaagtccgtggatctttctttcctttctctctgggatctgtcctcatgttagaactattcagttgtaagttacaaaaccccaaccaaatctggctcaagtataaaatagattttattggatcacatctcaggaaagttgcatctagccccctaccagacatttttgggaatggcctgtctgtgcttcttggctgtattgtcctctgtgttgttttcactgttcggcaagtgtttcctctgcagtattagatgtggaaggtgaatgctttatgctgtttgcatgactacataaattcctattcattcctrttcgttttctaccaataaaattgagttctactgccctgccattttgcttttaatgctaaatcatgaaattccagagcttgaccttaaaaagcagcaagttttcatatttaacataaagagtctcagaaagagataaaggagatgtttgctcatcgggaggctcccccagggagagagacctttctgcattatacaacttgttccaaaaattctgatttcatggggtgttcaattgataacattcattagaatataaaacctgtttttctgtgcactgtagagacttttgtgrctattcctggttattaccaacttgttctgttcactgttttcggaagactaatttgaacaaaggcttctagtaaaactgccaagactttaaaagttgttacaagttgtgaaactgtccttcaaagagcaacttttacctctgactggttgcctttcttgataatgtgttgccctggcaataccgttgaaatggccacctctacatttctgcaaccatatatgcccttgcaaatattttaggttttgtgagtcatgtggtctatgttgcatttattcaactctgcccttgtagcaccaaagcagccagttagcaaatgggcatggctgtgttccaatacaactttatttatgtacactgaaatttgaattttatatagctttcacatgtcataaaatattattattcttttgatttttcaaccatttaaaaatataaaaaccattcttatcttggtttttttttttttgagtactccatctagaaatctctttccccagatatttgtgtggctaacttccttacctccttctaggctttccttacacttcactgtctcaatgaggcccaacctgaccatcttgtctaaaactgcaacacccattatatccccaccgctatttgttrccccccttaccttgttataattttcctatagtacttagaaccttctgaatagtaaataatgtatttatttattattgtactgtttgtcttcccttgcccaatgataagctccctgaggtcagggttgttgtgtttaagctctcagatgactccaaaatgcytacaagattgcctggcatgtaattgacactctaaacactttactgaacaattcaacagatgaattaatagcctgtcaaacctatgatcaaccattagattggagttcaggtcatttgataataaaagttgatttccagatccttccaccaaaaagacacatgcattctcatgttcattgcagcactgttcacaatagcaaagacgtggaatcaacctagatgcccatcagaggctgactggataaagaaaatatggtacatatacccccatggaatactatgcagccataaaaagaacaamtattatgtccaaatttgcagcaatatggatgcagctggaggccgttatcctaagcaaattaacacaggaacagacaaccaaataccacaggttctcacttataagtgggagctaaacactgggtacttatgaaaacacacacacacaaaagttggtttccttttcttgaagtatacagagggcttggtcttcagaaatggaattatgtaagattcacttactgttggacactccattcagaataggtcaaagaactccttcaaattcagagaaaaaaaaagataactgggttttaacataaaaaatggattaatatttattttatacttctttcccaaagtttgctttatcccctgctcaagtatcccctgacactttagcattctgcatcatctgaatcttcctccaacctccccactcctggtggtggccggggctgatgactagggacagtcttaagttgctgacaatggggaccctgaagtggaaagactaggccaggagcaaacaacttcattttttgccttgaaaggtcaatttcagaaaacaaatggtaagagatgtttttccttatttttttaaagaaattcatggtctgcaattgtatttttccccctttttaatttattatttatatgtaagtatttattattttcccttccatgattggttcattttttcattttttggttagtatttcattaattatacaactagcmtgcactacaatatgagattatagccatatctttgatcaaattttgttggaaatgagacactcttgaactgattttcttgattcactctataagcaccttaattgaaaaatacagattatcttacagtgcccccttaaaactaaagctgtattctagcctctgtacttctttttattattattatttttgagatggggtcttacatgttgcacaggttggtgtgatcatggctcactgcagcctcaaccytgcaggctsaagtgatcctcccacctcagcctcctgagtagctgggtccacaggcacacacgagcatgccaggctaatttttctttcttcttttttttttttttttagttttaatagagacaaagtctcactatgttgcctaggctggtctcaaactcctgggcttgaactatcctcccacctcagcctcccaaagtgctgggactacaggcatgagcttctgcacctggcctgtacttctttgtagtacattttatatttcttgtaattcacttactctttctaactccagattataagtatttatttacacatstatatttgtcattatacttaaacttcctgaaaatagagactgtrgtttactcatttgtatgctcctcagatcctaagtgtttaattaaaatcttaattaatgaaatgaaatgaaacgtacatagttggcttacccccaagaatttcaatagctccccttagcttgccatgagaggcttttccttatcagagccctgcctttgtctatagtcttatcagctgtcattccctctcaccctccagcccctataagctctagtccctctgggccatgctgttgctcatttcttgcctttatacatcctcttccctcaaactaggttacccttttgactgcatggtgaatgcctcaccatcttcaagccttagtttatacttatctgtttattgtttccctcattagccttttaaactccatgaaaataggggcctggtctgtcttgttcactgctctctctccactgtctgaaaagcaagtagagactggatcaggaaagatcttaaatacaataaggagttttgattatttctagggggtaaccaggaaccactaaaacataagcagagaaagttatgtacaggtttttgctttagaaaaatctctctcatcgctgtatggaggaatggtttggagaacgcaggactggccctaagaaatcaatcagataattagagtaagcaaaagtgatgaggatctgatctgtggctgtatcagtggggtccgaaaggaggtgagggatttgagagttaggagagacagaatggcaggaattggtgacctactggatgctgtgaccgagggtgagggggagtgagggacgatctcggcttcagatttcactctggctgaggatatctggaacgatcgcatcgtattaacaattgtatgtttacctgtggatcactcccaattagtctgaaagcatcttactatagggaccttgctttgtagtctttgtattaccagtgttagaagagcacctgttatgtaggaggagtaataaaatgaatgaatgcactcaaaacactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaaggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttgaagactagttcactgcctgccaggagctaaagggacgaggggtggaagcaatcagaacccactgagcagtttgagacagtacacaatgaaatcaggaccgatcacagtgggagggtaagcgcgtgtagtaacgggctagttgtgttatgtggtgttgcaaaaaagttaatagcagatgagtgggaaggttgaattgtgaatacaaaggtatttgggattttacagcattagaattttaaaaagtaataacgttgctactcactgtaactaaactgctacccaccactactcgtttcctttgtatagttgtggcctgtgatagactggtaagtttgaaagtgatcaagtataacttgtgatactcagaccactgtgtaattctcaagaccttataatggaagcttgaatttgactcacaaattgaaaataatttctaagcaggatgacagtgttttgttgatcgcctgtagaagcatatcaaattataatctattgtttttctactttaacaaaaaagtatcagtgacaatagagccttgttctggattggaatctttgagtctcaatgttcttatctgtaaaatgggatattacctacctcaaaagaggtatggggaggattaaacgaaacaattatgcacttaatgtgcagttaacattccatgacaacagttgtcacagtgtcttttttgtcatttaatttcttttacttattattttgttgtatattttactttattactttgctataaatttaaccttgccctccttcccctttctgtccgcaaaggaactggaatattaatatgtaacacttaaatagcaaaactatgtgccaggcactgtttttatccgtatttattttatttaagaaacttcttaaataaaacaacttcttttaatcttcataactctatgaggtaagttctattagcaccctcattttgtagctgaagartctgaggcacagaaaatgtgggtgattatcccaagttcacacaaccagtaagtatctggacccaggatttgaacagatcattgttaatctgtactttcaactccagaatctgtactttcaactccctcttttggttcaattaatttagtattttgaagttaagaaaattccacaagaacatatatctgaacatatacctgagaaggaggtattttatgtagtgcttctagttatttatgtgatattttttattgcagatgaaacagaatttagaaacttcatcgtttggcttgaagaccagaaaatcaggcactacaagattgaagacagagggaatttaagaaacatccacagcagcgactggcccaagttctttgaaaaggtaatgaattaggaagtaaagtaaaaatacagagagtttgtctgaaaaatcatgaagatgagcttaaaattactttcttcttttaagaaaaaaatgataatgatcagtgttaggaaagctggatttcagggattttgcttttttcttagatgtgtcttttgcttttagagcaaattattttatgtcttcctaccaagctttcagtattaggtagaaatagttttctctagaaacatgaagtttcttaaataaataatgatgtaaatatttcgctttccctttatggcccaaatcagaatttttgttaaacacagtactatttcttatattaaaagaagacattggctaggtgtgatggctaacacctataatgccagcactttgggaggctgaggtggcagatcatttgagctcaggagttctgacagcagcctgggcaacatgatgaaaccctgtctctacaagaaaatagaaagttatctgggtgtgctggcctgygtctgtagtgtcagctaattgggaggctgaggttctccagcctgggcgacagagtgacaccttgtctcaaaaaaagacattattgagatgcttgaaaaccaagactgtcgtgtttatgcttatatttaatgtaaacagatatcccttgttgtatgctagggaaatagtccttaaatgatctctggtatatcatatttttgtgccttgaatcattttcccattgatttagttttagtaacacttttgcataaaaaagaattctcagattagaataaaaatgcttttagtgtcatttcttacattaaacattttcatcagttatatttgatgagtgagatatttttcttgaaaaaggctaagtttttcatttgcgagagcagtgtgattaggcactttctccctagaatcagtgattttataaattagggattgtataaattacatcattgttattaacctttccgtgtctcaattttttcatcaataagtgagggtaacaatgatacctatctcataagtgtggctttgtttttaatgagtaattgttcacagaagtccctggcgcatagcaagtgtgataagcttattactgccaatgcctctatactactactattaatactactgtattcttttcctttgctcttagaaaatatttttaaaattttcagtggacttcttaaaactttgaaatatatttttaggattttatgtttgtttatattacattwtatggtctattcatgtgtacaagacagtacagaattctgcatgtagaaaggtatctggagaatataaaaaattgtctaggctgggcacggtggctcatgcctataatccaagcagtttgggaagccaagatgggtggatcacctgaggtcaggggttcgagaccagccgggccaacgtggygaaaccccgtctctactaaaaacacaaaattagccaggtgtggtggcgcatgtgtgtaatctcagctgcccagggggctgagccaggagaatcatttgaactcaggaggcggaggttgcagtgagccaagattgtgccattgcactccagcctgggcaacagaacaagactctgtctcaaaaaaaagaaatatgtatgtatgtgtgtgtatatatgtacatatacacacacgtatttctgatgtgaaacacctggaatgacagtaagaataatttcaacatatcagaacctaaacagttattatccttcaagttgattttattataatcttatattacatataattaatgttacatataatactattatatgcaacatttatttgaatatacagcttctgacatttatttaaattacttggttacaccctacatgtatgttacatggctactcttttcagtggcatttccataatatgaaagttaaggtttagatagataatgatttattgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttmactgtcctttcaagattcaagatcgacaagaagctattsactggcttcttggtttagctgttagacttgaatatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattractgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttaygtttactgtcttagcacagatacttctatggttggaagcttctgaatgttagyacctatagtaaaaacaatttttctttaaacgggtgttttctcttattagaccatttcattttgaaaggcctgccaacatctaaatgcaagatttgattatcttatctgcatcccctgcattttgtgtttttcggttagytacagycytsttaattatttactttggaagcctttttatatcttggcttatccctttcccttcatcccacctacactgactttttctcatgtttgwtgtatcttcattcccaytggcataatcctaattcaggctcttgtcactttctgccaggagtattataatatctcccattagtgtcaccttctgttcttaactgcatggccaaccaagctaactttctgaaacgttaatctattttaggatgcmacttactccttgtttccaaagaacagttccagttacatattcatattaataaacatacatatccataaacactaatttcccattttctataaaaagaattttaagctcctyagcatggtagttaatgatractgatatccaacctgtattmacatcttgacatcccagctaaattagaataatagtgcttcctgtttatatcccatttccccctctgtttctttgttcacacttttcccttggctaatataccatttcattctatctamacatctaaatcctacccatctttttaagatccatctcatatgcygtcttatgtcttagcagcagtataatttccctctgaacttccatagcttttaaccctatacattttaagtcattaacmactttccattttgcttctatgtcttattcgtcccagtaatttgtaaactgatactcagctttgattcctacatggtacctctcttagcttccaattgatgctgtaacaaattactacaaactcagtgactgaaaacacaatttattattttagaatgagaaggccaacattagcctcactgggttcatgtcaagttgtcagcaaggcaggttccttttgraggctctcgggggaatctgtktctttccttttttaacttctagaggctgcctgaattccttgactctggccccttcttccttcttcaagtctagcagcatagcattttccagtctcttatctgattctgcttccattgtcataactttgtctctggctctgatcctcctgagcccacctggataatccaggataatcccctatctcaagatccttaattttatcatatttgcaaatcttgccatgtaaggtaamacatacacaggttccagggatcaggacatggacatcttggggggtacaggtcaatattgtgtctgtcacagtacctgacatagtttcttgcacacaacaggtgcttatcaatttcagtaatgtgtggcgaatgcagtatatgtgagtgttwacatacactgatttggagcatcagccaatttttkgctgatgcctcagacttaaatttcagaagccttatggcaaaaatcttaaggaaagctcaatttgagacttcgtttacttttccatttaatttaaaaaaaaaaaacttttctttctttagaaaatacatgtattcataagccttatggctttagtgtagtattgattttagggcctttaacaaggtctttttatctaccctgctctggattggtaggaattgtatatgagccaatttgtagcttatcaaaactgtttttcatttattcccaaattcttacatctcagtttatttgttttattctatttgttccatttttataacccgttaaccttcaatggtagatgcatatggtcatgtatacctgcagttgactttagtaagtacatgtatttctcagtaatagcatgttcttttagtgaataaaagaagcttgtgtgtggaatgtaaatttttcaatattgaaaaaggaagtcaacatatacttgaaggtgaatggtatcaaaagtatattaaaagtctaagctagaaaacaagttttgtttattaaaattcagaattgcaaaaacagacttgaaaattggtcaaataatactgtctctaatcggtaggaggcgctgatgttcttttgtggttttacattgatatgttgcctccttgacttttaagttacttattttaaaatttgctgaaaccattgtgagtttttattatttgygctctactattttttgaagccttttggtagcttgtcaacatgatcaataactgaaattttttaaatgtataatttcagatgtatagaaaaattacaaaatagtacaaagattttcatatacctcaagtctacaaatgtagcgtgttacctcatttgcttcatccttctctctacacagaggcacacaccatttttttccaaaccatttgatagtaaattatagatgattcctttttactcttaaacactttraagtgcatttcctaaaaacaactttgtcttatataaccacagtacagtgatcaaaatcaggaagttatctttgatatactattatttattcacattttaccaaaccccccacttctctcgamagaaaaaaataacccagagcaatcctggattatgcaccgcattagttgttacatctgtcttagtatcttaaaatctggaacagttcctgtctttatttgtgcttcatgaccctgacatttattttgtagagtgtccctcaatttggatttatatgatgtttcctcatgattagatttggggtttatacttttgttaggagtaacacagaagtgatgtgttctttttagtgcatcatattaggagatacgtgatagcgatatgtcccattactagttatgttactttgatcactaggttatggtttctccactgtaaagttactattttcctctttgtaataaatatatcttgtggggaggtactttgagactgtatcaattatgtttttgcgcctcaagtttcccccactagttttagcaaccatatgatgattcttgcctcagtcatttattatgttaatcgacaaaaggtgttctctaatttcatcattttttctacatttatttgttggctttctcttgtaagttttcccatctctaatttacttgtttaaatcagtatagatacatggatttttattttattcaatggattataatcctttctgtcatcacrtattttgctgttgatactgttccagatttggccagtggaagcctttttaactctgacttaaattttatgcttttattttttcctcgtttcattaacagatcccataagcactgtatagcctaagatgccattttgaacattaagtttagtgaattattaataagtgtttttatttttgaattcctttkaagtattgtttttcaaatgaaaataataaaatctacctttggaattctgaatttcaagtttccatgaaataagtttgaggtttgtatatgatggtrtatttgatgtattgatttttttggggaaagcaaggtttttggattttatgtacagcattcaaaagaagatggggggaaagcgtactttttaatgagtttgtatttaatcttacgtaacctatacttaaccctcctcccattcttctaccccagatttcagaggaagctgtaaaagcagatttttaccttcctaaaatttacatgtttgaaatgattgcctttagaaatgttaatgaaaagatatttgtgtcacatagtccagtaattgctttagcttaatcaaaaagatagttacattgtctttttacattttctatagcaaaaattaagcttgattgaatgaattgttttatgcttatacaggttaagcatccctaatccgagaatctgaaatcctaaatgctccaaaatccaaaactttttgagcactgacatgaggacacmagtagaaatttccacacataagcacttaacacaaactttatttcatgcacaaaattattaaaaatattatatgaaattaccttcaggctatgtgtataagttgtacattgaacataaaaatgaattttgtgtttagacttcagtcccatccccaaaatatcccattttatatatgcagataatccgaagtctgaaaaaatttaaaatyggaaattattggcatttccagtaagggaaactcaacctgtaatcattttggctcagttaaatttggtaaatagcagtagtcattttaccttgagttgcagttgtacaaattatatttttgcctstttttatagctgaaaaatacaaggatttagtacctgataattcaaaractgcwgacaatgcaactaaaaatgcagaaccattgatcaatttggatggtgagtatataaatgcataacattgaacatcaacatttttggttttttaaatgtttttttctttgaagaatgaagtccaggtttacttggttttagtaaatttagaaggatccatgcagacagcatttatgttaacattttattctctataatgtttttatratgtgctttctccttccccttgcatttgaatatctgaatgttgatttgatttgcttctagtaatttggagttttgatttgtatttaatcatgggggtcattgtttgcctttttgaatgtgtaaatttcttttaatccaatgactctatcagacaagtggtaaaattttccattattttaagtcctggatatcttttagtaatttccctttttaaaaatatgaagaatctaattacctaaattatgatgtgtaaaatatttgttcactggctaattcattgtgacctataatttaggagttaacccttttgaatgagtgagcctcttggacactccagagctgctgcttagagagaaggttttgggaaaactatccatggaggggatctatgtactaaaattaatggccttgggaagaaatgttaattaaaagtgctgtataatttagccttgcagaaaaagttacaggacaaatataatgtgagttaaattagtcatttattggattattcagtttggctgatgaaatacagatactccttgacttaggatgagatcatgtcccaaagtcgaaaatatcataagtcaaaaatgcatttaataccccggaagacccattgtaaagctgaaaaattgtagttggaaccactgtaagttcagattttcctcatcttgcactagggttacatcccactgaactcattgtaaggtcaaaaaattacaagtctaaccatcctaarttggggaccgtctcatacagtaataggaaaaccattttatcttaccaatttatttaattgttgatagtctacagggctttcttttttctcttgtgagtagcagttttaaaaactamgagatttgttgctaccgaaaagttaaaaatgtwtttgtatgttcacaaatatgtttgtaattatacgtttgcagggttgtaagtttttgtttgtttttaatcttttatagtaaataatcctgattttaaggctggtgtgatggctttggctaacctgcttcagattcagcgtcatgatgattacctggtaatgcttaaggtcagcttcatgttcttgattcttgacagaaactgtgcacatagaaaaatgtctttattttctaaatattaactrttgatattaaaattatggttgaatgactaaaatacacagaagaatatgaaacataaagtagatttcatggttttatctgatttggattctgttttctgcctgcactatgctaaatcctttgcaaagatgttctcattcaatcctgccaacaatcctagagacagctgctaatatctttttaaaaatatatatcatatgaagaaactgagactcaatgaggataatgtctaagatgacacagaaaatgacaragccaggattttaagcactataaccctgtggtccattgtttttcccacattaccctacttctgtttagtkagtctttttaatgattcatagtctgcatttgttaagatggtcgaaaatgccaaatgagtaatggtgaatttggtcaaaaatatataaccccaaaatctctttgagaaatgaatctttctgtccccgatgctagataggccactcagttcataactatacttcaggaatcccagtaatctgaaagaggtctcttgtttctgagagaaatcataaacttcagaagatttattcctagtaatcgtgaaagtacagtggtgtggatcaggggagtggtacttaagataccagacttggaaattttataagagattaaaagcttttaactagaccttgtgcatgtaaactactttgtgataaatatcactctacccagaagagattaagccataacttaccatgctttttagatttttattattaaatgtcagttttaacaagactgttgtattcctaagttattaaaattttctatactgaatctgaatgttaacttggattttctcaatccagattrcatgccaaaagacaaaaatgtttttagtgaaatttagctatttcaaaggcttgttctttattccgacaattatgtaaattgccttggaactgttctatagtgatcatgtcagctttaatcataaagtaagtgagaggagagtcagacaatgcatagcgtatttgggatgcttttgttagacttcaaaacccaaggggataaagtataaatcaactacaacaaaatgctataaaattctagtcctgctgcacatttgtcccttttgagttattttaagaggcattcaaacaatarcataatatggaaaacatcttagtacgtttgccaagtacaagcatcagtatattaactgtttggcaaccagactatttaataacatctgcaataactgttaaacattgtttgaattcggtttttcaaagatagcatttggttttttatttaaaaattatagtttaagttttcacacttatttttgagttgtaattgtcatcttcctaattaaaattccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagacctactttttaccatgtgtcttgctgtatttaaagttgttttttaccagtcacgtgcattacctattcaaaaaatggttttaattgttgcaagcaccattcaacattattaaaatactagaagtgtgaaaggttacgttatattagtgggttttttttatttttaatttaatggggagtttattaatgaacttaggtaattctgacttcatcaaaatgagcatccttattctctgggctcatagaagaaaggatgacaggtacacagcctataaaaagtaaaaatatttttgggtttcttaggcaattcggattttggttcaggagcgcctgacacaggatgcagttgctaaggcaaatcaaacaaaagaggtacgtttctataaatcctaaataagttgttaatgaacatttcttctggtatggccrtgattttaaactttgcatrtatctgtttaagatatccattctacgttctacaacttagagaaaggatagcttacttcagtgcttcctaaagcaaattgaatgtattcagtggctagggggkcatttttgagtgaaaaacttcatgttcctctcactttgtaccttaaaaaagccacaaatagctcatgcacagtccacaaatcatgcttgtggcccgttgaagtttatttaaaatgagttacccatatgaaacttactggattattttgactcatgctggagaagaaggaacacacctcactacaaattagttttctttttctatctaaattctatccttgctcttatttcttcagagtaaattcttgttttattcaatttcctggcataaaacatgagaaagtaatttggctaaggtcacctagttggtaagtgactgagctcaggcagtctgacttgagagcctgtgctcttacggtaggtggggagaagggtccatgcgtggatgtctgcatgagcttgtcagtctgcccaggtgaagggacagggggttctgttggagtgtaaggttcaaggtacaggtgactgaaatggtatctttcagtcctaccttgtaggctgagaaaagctatatcccatgactaccttccccttaaagagaaaatatggaacatttttagattatatcagaaatccaaagatgcctaaagtttcactggctgtgcagcggtggagagactgtcctcaggtcagcagcagcagtgtctgataacacctgcctcctgcagcaatgatgttgtagtgaatgccttgggcacaactatgttgtttgtcctccctgcgcccttcccccatctcccaatgccttttgtcctccagcccctttaggcaggccaagcagtgttaaaaggttactaatgccagggcagtatctctgaaagacactgttttcttttaaaggttcttactggctcgttgtatatgaatcgagccactggaagttggrttaaagatcagcttatttcacccwcmctatagaacagacagtaaattgttctggtgtaataaagtcawtcattcatwcattcattccttcagcaaaactatgctttggaaggcagtgtaagtwaaggcttagccaaatctctttgctcttgtttgtaaagtaaaatttagttttatttttaatgctccmaattttaattttggtgtcatctcaaaagataccagcctataacaatttagtggagttcttacagtctagtgtacttataagcatttataactactatttgaggcatatggtagttttcaggggtagcttggtggcctgttggcaaaggaaaaaaaagtggagcctctggtactagatgaayatataaagccactcagtacaattctgctctttaattttgctcacttgtgctttcgtacccattggtttcttcagacttacatgtgttagctgttttaaagcagacagagcctacgtagatttacattactagataaggcaagaattgagcagtgactaaagcatttgaatagtaacaggttgtaacattgaaagattgaaagtacgggtastgtgtttttcttggcagtgattttatataatcagcaggaagtacagactgtcctcattttagaatttgtttctgtgaagtttggcatcaccatagtcaccatctttagtatgtccataggtgctgagtggtttagtttttcattttcctagactgtttgtttcaaagtaacttccaagtcaagtcttgaaagttaaattatacataattatacataatcttggcaaacaccatgctggctgaaaggttcgtacaatttgtaaagacaaattaatgtgctcagaaatggaatataaggtactatttttgccgtttatactgttgcttactgtcgccaaaataagacagtaacagcctggctcaacttgccttccatagcagtaatgacaaggcactgctgcaataaggatatattgttttgtatgcctgggctaaaggattggatgagctatagagcttcctggtacatttaaaggttaacttttccccctaaccggttgaaatagggaaaactcgctaatcacaatcatcacaaagcaaatataaacaaaattcctagttcccttgcccatgcagctaaaagagttaagacaccagaatagctaggtgcttttcagtttcagttgaggaaaggatgctattcttaaccataaatactctcrttttgtctttctttttttaaagggcttacctgttgctttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttytttaataaagtttaggaaagtagaatttttattatgtactgtatgtttgcataaatcacctttctcctttgtggttaaggcatatatgccaacccccagctttgtcctagagacaatatagatccttaagtcataggaaaacttaaaacactttattggagtaatctagaaaattttaaaattgttacatctttggtatttataaatgtgatactttactttctgtgggtacttctatagaggcactacagratcagaaaatgcaaattgaatcattttagcaccttttgatataaatagaaatgcactgatgcagaggtaaaaaatcttagaacttttgttgggaaactataaataattggtcctttcccatcagttctgcattggcttctccaactgtcaaggtttaggattatawtgttatattgatcacatgtgcttwaatttcttggccagaaggaatccatggcaaaaatcaggtttagagtcttaaactctaattcttagttgaatgaatttgatcttttaaatattaatgataaatgttwacaagawgttgctttaataagcaacagttaaaattctgttacctttttaaacttgcaataacaaccttcatttttaaaaatacagtagtaaagattgaggtatcagcttttcacaaaagtctttttgcactacaaaatgttcatcttggatgctcaggaacgtctaatggccaattccttttttactttctttgcctttgcagtcactgttctttagggtccaggttctgattgtaaactccaagtcttcctttacattactgtacttactttcttcctgtgagagaagagcaggggtgggacagggtggtgggtgagtatattgtaaccaagttgcaacagcaagtctttgcattttgtgtataaactaggtagatttaaggtagtaaagactggccctcagggcaggaagaaggcaatggtggcagtgtcacaggcagcaggggtaatcaaataccatatatatcccttctctaccctgctaatttaaaggagcatcctaaagcatactttttacctgttgggcagtaggggtagactgcagttatcccgtagaggtgagatcgttgttctgggagatactcatcagtaaactggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctctaaatccattgctcatctctagctgcatgttagaatcacatgatgagctatcaaatcagagttgtagggcatggtgtaaagggcttagactttaatgttccacagttcctcatttgagaactagtctaaatagtatttttcggtccctcagacaatatgtccacagtgtcaaaagccaacttaagccctgtaatatagctcatggtatcaagggtagtcttattctctaaagaacatatttagattaatatgctcccttttgagacattatccaatagctttgctactttttaagctatatgtgagcaataccattcgatttctgggtgaagtaaaaggatgatttcaaaaacatgaaaggatgaaaaacatccttgaaggatcttatctgccaatgaggaggtgatgaaacaaaagcctcagagggcttaatgagtcaagtcaggtactgacttttgktaaaacaagtggtgtgtcctctggaacagttggccttttcaggcttgtccagaatttgtggggctcacctcctccagtctgtgtggtagaagtgatctgcatagcttacgatgctgaaggggtacttgaggttgttttgaatgacacgccgtccagttccatcaggtagtgtacactccagttttttggttccttttaaaacaaagggggaaaatgaggtccttcagctgctttgccaaaaatgatrgtgacatagtgatagtgacacagtgatagaatggggaaataggatattttacttccattacagtcatagattagcaactgtaaaattacctgtcctattactagtctccagtttttagtagagattcaaactttcaatccttttttggaagacaggattgcatttactgaaatctggtaagtttctgccaaagtagggcattaaacataattatttttataatttgtgtgatttcaagccttagcttataaattataacatctgggtaaatacttgccctttgtaagctatgtctrtaattactgaggcaaccttttaaccaaaatccttagtatttttaaaatattttctaggtaggaggaaaaaagtgactaaaatggtaacataactyatatttcaatgtaaaggaatcagtcttaaaaatttttacaatagctaaaccattcaagaatttccaagtttcacatttctcatggagccgatttaaatttcaaatccttttaagaaatgtaacttgttttaaacaactgggttataaaagtgacctatgtacattaggcccttttattagattacaaattcaagaacagtctttttcatattctttagtatagaactagacacacagcattttttcagttgtgctgataaaagcaaacaaatgtaggttgctaatacccatgttattactgaaggaagctaccctgctacaatgctttccaaagaatgtccttagcattataacagatgtttataggtaagttatagtgaccctctccccrcataagaataacttcacttaagtttgtcaattcaacaatggctaattcttttaactgttaaaaatatgccaggcactcatggtcaggcaagcagtacaaacttactgcttgatatatccttccctccacccaaaccccagaaagttcattttaagactcatttactagtacttaaatttactagtacttaaaagtttacagaccaaagaaaggagatctaagtkatgggatttcattttgtagtaaaatctgttagtgctcacattcactgtgatgagaggttatctatttgcattccatcagtagtattacctgcatctgcccagcagagcagtttagagaaagggtcaaaggttaagccattgggcaatccaatgtctgtattgatcagaattcttctgttttctccatctaaagatgacgtttcaattttaggagcttctctattccagtctgtccagtacaagttgctgtaagttaaaaatcaagattgtaaaagaatagcyatgtagcctgtggtaggcagcatctaagcagcccccagtgatctccatctcctcatgtattatagccttaagcaatccccttgagtttgggctgcattagtagtgtcttgcttctkctagtgcatagagtatagcagaagtgataggctatcactgccgatattcggtctcaaaaaactggtttctgccttaggggctctctcttgctccctttgagggaagctggatgccatgttgcaagctaccctgtaaaggggaacatgtgccaaggaactgatgtccttgagggctgttggccagagacattagtcttgcctgtagcccatgtgagcatgcttgggctgtgtcttccccgagctgagccttgtgatcactgcagtttggccattacctgattgcagccttgtgagagactccatgcctgagggagctcggtgaagacacacttggattcctgactcacagaaactgtgagactaaatgttatcttacactgctgagggtttgggcaatttcttacacagcagtaggtaactaatacacagccatattccacttttacctgtatcacaaggttttctgattattgtcactatgtgggagaagtcattactaagttactatcagaatccctgcctccaagataccccttgactcaactgccccaaaaccctccgtttgttgaagtcttgaattggatcttgggttttagaatagaaacaaatacagctgttaggaatggcttcgatacaaactatggaacttgaagagatgtggaccagggatttgagaaggaaactgttctttcttctgccaaaaatacaatttggtacttgaaggggtacctggcacccagggatggaaacattttaagttaagcactttaccttttaaatgccacgttaaaaatgaaatatattcataacagatactaacgaggaaatatggtcctattaagtggaaataggttataaggaaacaaacaggtttatcgttagagcagaaataatgttgaaagcactttttataaaatactattttataaaagctatagaagctttgaataaatcagttgggctacagagaacctcagtgagaggagaggaagaaaccataggtttcccctgttgcgaatttcatcccttatgcccaacagatgaagcagagagaagctgagagcaaaagctagaaagcagtttccactttgcgctaaggtggaggtggccagagggtacagcatgcatatcattgcttcatcgcttctgatcagtctcctccccaaaatgatttaatatcatcaacaacaataagtctgaaacaagctcacacagatatttggtgtaaattatttggggattgccagaggaagaaagttgtaaaggtgaaatctatagaaagcaaatgagaaatatgcaggaaggcttgacaaccattctgttacgcagttgaaggagatgtaattacatgtgttatattgcaacctggttcaaggtgggttttctttttattaaaaattcaagtcctttagcatttatatttgctgtctggataagaaagttctactttcatatttaaactcatggctgtgatgtggatttcagcttaaaagtatgctttttccccagactccagagacatggccaaagtttcattgcctacaagatggcagctctccccagttttcaggtcaagcaccaagaaggaataaggggccgggcgcagtgrctcatacctataatcccagcactttgggaggccaaggcaggtggatcacccagggtcaggagttggagaccaaaatggcgaaaccctgtctcgactaaaaatacaaaaattagctgggcatggtggcacatgcctgtagtcccagctacttgggaggctgaggcaggagaattgcttgaacccgggagatggaggttgtagtcagccgagactgtgccactgcaccccagcctcggcaacaaagcaagaccttgtctcaaaaaaaagaaaaaaaaaagaaaaaaggaccttccaaatgtccaaatgtcagaaaggcaagcctatgcaaagagtttttaagagggctattaattcctgttaagtcaactggaatagagaaggatacaggtacttttcctgtgtgtagaacccaaagtttgaaaccacctttgaggcactgcactaagtatttcatagtcaaaaagcacttacctgaaaattaaagctgaaggttttctttactgatttgaagggcatctgggaatttcatttcgtagaaactccacttaaacatggcaagagtttctcaagatataaaaattctccctgattgtaacaagtactgagacagtgracaaatcctgtatgtcacatttgatgaccttagcaattatacagacagggaaaatgtttatcttgatttctgctacagcaacactgaagccagaggtgtctgagctttggctaatgtcacttgatgtaggtcagccctactgtgagygtcaaccctggtttctaaatgtgctgctggaggaatcccacttcacttccagtttaagtgtcagctgaggcctcgcctgatcatttgattcagagyagccctagttctcacaacactatctgaattttctacatatcacatcacagactaatattgtttataccagtcttgtttcctcctaataaaatataagtgccatgaaagaacagaccttgtcttttcctagaacaggtcctgacacctcttagatcctcagtaaatctttgttacmtgaatgcatttgagctttcactctcttgttctgaccttccccacattgtatttaaaacccaagggcttcacatcaggatctacaggtaagagaagaattagggaagcccagctgaccctcggattggatccacagcgatggcacggggattcaccagatctgtgtagaagaggaccttgcgctcagagccatccagcagggcgctctctatcttatccaggacactgtccgtccagtacattgttctgcggatgtggtctatggcaagtccttcagggcttatcagacctggaaataaagcaaaktcaggactggagtgtttgcaggatatggagggcaaacctgaagccctccaacrgtcgggtgggcaggggggtcagcaggsgaaarcaaagcccaagtgtctccaagtccccaagaaccaggttaatagagaaacaagtacttttgttacatattccactacctctagcttctagaccagcagacctaccagtttgatgacaaccggcatccacagtgccagagccaggctgaataaacgaaggcgtcaccctgaattcttaccatgaattcttttaagaagtgcgcacagtaggaatcacctatttcattccgtatgtatgaaggtgtttgcttacagagggggctagtcttatacagctcaataaaatgacttgcct

SEQ ID NO: 13301 - DNA, 35997 bp, Homo sapiens
  misc_feature (1)...(35997): n = A,T,C or G, or insertion/deletion polymorphism (see Tables 1-2)
agtacccatgacgaagatccctagtaaatcttttttatttttatttttttaagcttcagggacacatgctgaagctggtaaatctctatttccagtttcctgattgtaaattcagactgtcttgtaaacagctgtaaactaagaataaaactctgagctctgcaagcatgtgaatggaccccttctctgggccaagggcattccaaagttcaggccatgatgggaagagggggcaggacatgccttcctccctttggaattcagacacaactgaccaacattaatgttaaaatagagatcttaatactaatgaaacagcttttttttttttttgtagcagtcagacaccaaattccagcctggtcctagaatagcatcacatgacaaagagcaggccctgaaagaaatygaagtattttaccccaaaatgtatttctttggcatgttttgaaatggtcctgcaaagctgtctcttgtgggggaaatctacattctgtagagaatccccttcccttttccaggttttttcctgatccaggagagaattaactaygagtttggcacattttaagtctgataagagacatttacaatctatcctctctgaaaccttctacctggaggctttatctgcataataagaaccttggtctccacaaccccttatcgtaacccagacacttccttcagttgattccaggtcttcagataaactcttttaaaccaattgcaaatcagaacatctttgaatctacctatgacctggagcctccccgcyygattatagttgtttcaccttttcaaaccgaaccaatgtacatcttgtatctattgattgatgtcttatgtctccctaaaatgtataagaccaagctgtaccccaaccaccttagrcacgtgttctcaggacctccygagtctgtgtcacgggcacgaccttaaccttggcaaaataaacttctaaattgattgatacttgtctcagatactttttggtttacacaccaaaaaggctttttttacttttattttacatggagtactgaagtcctttcaaaccaaaactgaactagcccccatccggagaagtctgagaaaagaaaatgtcacgctattgctaagtaaracccatgtgttttcagtcatggttagcagcagggaccaattaagcaggtgggaaagaaaaaggctttccctgaagtcaggtctttgttatgacatcttatgtttgaaaygaattttctgaacattaaacaccaatgagtcaccgagttccatggaataacaattgtgactgtgatcctctacaaacggacaatgagatgcctgccttcagctctctagtgtcttctaacagtggcattcacctctcctccagccaccacctggcactgagatagcttagaggcaccctgaactcagttttcaagacagctgcctgggaaatttcttgagtgaaggcccagtccctgaaaagttctgaggaaaactaaagtgtgactcagaagtccattgattcacccctgctcatctttccttcctcactctgggtccggagagagggtgaggctctccctcgggaggttagccccacgsgtatattgcatgattgaccaattccttattaaatgagaaaaacgggaaagagaaaaaatatagaagagcctgaatgttaccttcaggcaggaggctctggagacgggttttccaggggtcttttttggagaatgccagaatcccctctgctttcccatctgaaaatggctgaagaggggaagaaatggcctgtacgcatttccagtggtgccacatcaaactgctttttcacgtttgattatagacaacgaaaacccaggcctttgtcccatgagcatcagaaccactcatcagagtagttctccaactgtgcactcatctcacttattattagaaacctggttacttttggttttgattgcttctcattataagcctgttagaatacgatataatgaaaatgtgataaacatttatgaaacaactttatgccagatatgtctctctaggaggatgctgagctcagaattattaacctacgtaatttggaaatagttcttcaatcttatttaaatccaggtgggatggcagagaatgccagactacagaaccccttcctaggtctccctgcccagtaaacctattttgagaagaagccattgaggttaggaatgacttgccctttggtgaagctatatgggctcacactttcattttgtagatactaacaccacaagtggtcaggcaatttgctccactgaaggtatcagccaatgcaatcaaacaagagaaaacgattagagagatgaacattggagaaagaagtacaactatttctatttataggtgatgtagtatagctatagatgacttaaaagaatcaataaaaaatacaaatagtaaaaaatttcagtaaggcagcaggttataaagttaatacataaaaacaattttctcatccacaaacaaaagctagttggaaaatataatggaaaaaacttgcttacatacaatatcaacaaagagataaaataactagaaataaactaaacaagaaatgtgcaaatcttacatgaacaaaactttaaaggaaaaaggaaaaaaattatttgaaggaacagaaagacccagcatgttcttggctagaacaactaaatcaaagtacaaatgttggtttataacagggtaatatgtaaattcaatatgtttctaatagattaccaacaagatttatttttattttcatttattttatttttattttattttatgtttttgagacagagtctcgctctggtgatccactcacctctgcctcccaaagtcctgggattataggcgtgagccactgcatctggcctgtttgactacagtttaattttatttttttaattattatatatatatttttttgagacagggtctcgctccatcatccaggctggagtataatggcaccatctcagctcactgtaacctctgcctcccaggttcaagcaattctcctgcttcagcctcccaagcagctgggattataggcacacgccaccaggtccagctaatttttgtattcttagtagagatggggtttcaccatgttggccaggctggtcttgaactcctgaccaagtgatctgcctgccttggcctctcaaagtactgagactacaggtgtaagccaccatgccctgccaacaagatttttttctttagagctagacaagttgactcttaaatttgtatgggtgaggccgggtgcggtggctgacacctgtaatcccagcactttgggaggctgaggagggtggatcatgagttcaggagtttgagaccagcctggccaacatggtgaaccctcatctctactaagaatacaaaaattagctgggtgtggtggcatgcgcctgtaataccagctacttgggaggctgaggcatgagaatcgcttgaactcaggatatggaggtttcagtgagccaagatcgcaccactgcactccagcctgggtgacagagagggactccagctcaaaaaaaaaaaaaaaagtttgtatgggagaaaaagcaacaaggagagccaggaaaatctgaagcagaaragcagtaaggagaatgcgctgtacgagatattgaatcataagagaaaacctctataactgaaagaatctgaccaacagaaccaaatagaaagtttagaaagttcagaatcagacccaagtatatgcagctatttgatatataacataggtggcatgtgaagacattagtgaaaatggtttttcaataaacagaggtggaaaaactgaaagtcacttgaaagcgagttaaaattggatctatatttcccatacaccagaataaactttaaagggatcagcaatctaaatataaaaaataaaactgtgcaaatactagaagaaaacattagtgaactctataatctagagattattcttttttttwaaaaaaaagagattgctccttgtgaatagagaaagtttttctaactacgactcagaaacaataaaggaaaaatcattaaagttgactacattaaaagagtgtatgccaaaatcaccagaagcaatgtcagaaaacagatgacaagctgggggaaatattcgcaatttatatcacttaagactaattaagccacaactagggaggggcgtgtggtttgctcctggcatccacttggtgaatctcctccagagattctgtgaaacatgtgtgatggcaggacagcccccacaaccacaagtyatcgggttcatgcggtcaacagtgtcgcagttgagaaactctgccttagggtaagcacagagggagtaaaacagcttgagttctcaaaattgaactcatgtaaaacacctggctagtatcttccctacttccatttatgctagatgtttctgttttccaagactgctctgtctgagatggcagatggagttttcatacttacttggctaacctgtcagtaccctggggtctaattcctatgcctggagagaactggaagtccttgaacacacggctcaatgatgtgggctctgctcatttatatacatttatttttaaatttaatatatattttagtttttttatttccatagttttttggagaacacgyggtatttggttacatggcaagttttttttttttttcctgagatggggtcttgctctgttgcccaggctggggtgcagtggcatgatctcagctcactgcaaccaacctccgcctgctagattcaagcaattctcctgcctcagcctcctcagtagctggcactacagrtgtgtgccaccatgcctaatttttttatatttttagtagagacgggggtttcaccatgctggccaggctggtctcgaactcctgacctcatgatctgcctgccttggcctcccaaagtgctgagattacgggcatgagccactgcgccctgccaagtaagttctttagtggtgatttgtgagattctggtgcatctatcaccttagcagtatacactgaactcaaatttgtagccttttatccctcactcccttcccacccttttcccccaagtccccaaagtccattgtatcattcttatgccttygtatcctcatagtttaggtcctacttatgagtgagaacatacaatgtttggttttccattcctgagttacttcacttagarcaacrgtctccaatcccatccaggttgcsaatgccattaattcattcctttttatggctgagtagcattccaccgtatacgcataccacagtttctttatccactctttgattgatgggcatttgggttggtttcatgtttttgcaattacgaattgtgctgctattaacatgcgtgtgcaagtatcttttttgtataatgacttattttccyctgcgtagatacccagtagtgggattgctggatcaaatggtagttctatttttagttatttaaggaatygccatactattttccacagtggttgtactatccatcagcagtgtagaggtgttccctcttcaccaaatccacgccaacatctattattttttgagtttttgattttttgattaaggccactcttgcgggagtaaggtggtatcacattgyggttttgatttgcatttccctaatcattagtgatgttgagcattttttcttgtttgttggccatttgcatatcctcttttgagaactgtctattcatgccagcccactttttgatgggatttttttttcttgctaatttgtttgagtttcttgtagattctggatattactgctttgtcggatgtatagattgtgaagattttctcccactctgtaggttgtctgtttactctgcttgactattccttttgctttgcaaaagctatttagtctactttttttttttttttttttttttttttttttgagacggaccagactggagtgcggtggcgccatctcggctcactgcagcctctgcctcccggrttcaagtgattctcctgcctcwgcttccccagcaactgarattacaggcacgcgccattacactcggctaatttttgtatttttagtararacggggttttgccatgttggccaggctggtctggaactcctgacctccagtgatccgcctgcctcggcctcccagtgttgggattactggcgtgagccccgcgcccgcccctggctggcttctttgccgcaagctgtttcatcagcaaagtctttgtgacctgtatytagtctgctcatttttaaatgcgtgttctgcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctycgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgygcggggctgtgaccccagcagtmccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtgaccccggtcggccccgcggcctcggtgacccctcgcccgctccgcgacccggaggacgcgtgctcagtcttggggcgccgggtgttrggagccgggcgggaggcggagagaggccgaggggttcggcgccaaacggtgccatccgggccccctgcgtgtgttcactggactggccgtgctgggcttggccaatccgcagcactttcaggtcgcccagacctgtggagacgatcgtgtggaccagcccggatctccttaccgctctgtgtttgaattaaactccctacaggcaaactattacaggctttgatgtcttcaaggcaaagaggaaactttaactacaaattggcatttaagttattttcttcctttttttttttttttttttttgtcctaaagattggcttsggaaaactgaggtacagaaaattaataattaatgttcacatgctgtcaggaatactcagatgcgagggggcatctgagtccattttttgggcacttttgctttctgggatgctctcgtgcctaatgacagccctgcagctgcctgcatcctttctggtgggggtcaggcctgatgcgatgagatctgatgtgttcagtgaccttctagttaaggtcctgggccggccttgtattgctggggcttttatgtgtgctgggattaacaccagtgactgctgttatcagcatagatggcgtttgttctcatttcaggaccgtatctgagtaattgcatccattgtgatgtgccmccaaagagaaaagtactttggtyatactcgactatgtaaactaagtattttaagttaaggccaattccaatgcattttattacaattcagcatgaaacagttaacacggaccagtaacagtagagtgaaattagcatgaatagaaccaacattcttttccacatatgtaataataagggcacccaagcagatgttgtacggtcccagggaagaccncacaccttacatttccaggcttactgcacttgggattaagccaaggcatccaaagaaagaaaattttttttttttttttttttgccaggctggagtgcagtggtgcgatttcggctgactgcaacctccacctcccgggctccatacctggctaatttttgtatttttagtagcaatggggtttcaccatgctggccaggctggtctcaaactcctgacctcgtgatctgcccgccttggcctcccaaagtgctgggattacagatgtgagccactgcgcctagcctgaaaataatgtttaactcccatttatatgttaggctgctcagatatattaaacacayacacacamaamacacacacacacacacacatacacactgcacaaggaaacagagggacaaagcaggaagtccaagtttccattaaaccagtctttaaatggttaaatttagtaggaaataaaggcatccttaatagaagttgagaagcacaattcaatagtgacacctaaaaaaaaattaagacttgattagttgaataaaatcaattgtgaacattgctcagttactggtgatgctacaggaaaaaaaaagtgatgccaggatagatttgttaggcttgtttaaaaaatacataaaattgttcattaataagactttaatatccagtttttatgtctgtgattaaatatcattttttatttttaaatggtatagtttttaaattttgaaacaattaattttgcataaatatttgtctatgtacatatatacatgtgtattcacatatatatatgaaggacacttagctatcttatttactgaagctaaagaagtaggtccttaaaaagccattgacaggtcttgagtttgcaacgtgactgtgaaacaggcatccttgttactcacacgtttgctgaaaggataacagaaagccctcgatagaaaaatctcactagattgtttataatttgttgatatttggagtatcttgagtggtaaactttaaatgtggatttattttttctttccttttaggatttggatctctccaatcttttttatgattaattgttcagtgtttatgcattattgcgaagtgataatgaaaatgctcaaactcagggtcctgcaggcactgtgggggaggcagtggggacstgaggggattacagatccagtagaagccccccgacccccatctgcttccaccccatctccttccagaacaccaccgatagccacaccgaagagttctcccatttgctggttcccggacaaaaaagctgctgatcccttgagcacactgcagtgaagctcccagctgacrtgtcctgtccatgtaaacagaacttcctccatgtaaacagaacttccagcattgtttgtgttttcctcttaactatgtactgacatccaagggttgttaggaatgtttggaaagtctaggtacaaaagagagacctaaataaaataaagcaaacaccagccaccataacaaaaggaccccagagataggcagcgcagggaacggaagactcaataaactataattgtggtatccaaagaattagtatagaaggcaaaatggaatcaaatatcatgatgaaaagtgtaaatgagggaataaggtcagaagagaacattcatttatatgatttcttcttttttttttaaccttttaaacctctatttaggttcaggatacatacgcaggtttgtgacataggtaaactcatgtcgcaggttgttgtgcaggttatttcatcccccaggtactaagcctagtacccaatagttattttttcctctccctcctcccacccttcaccctccaccctctgataggacccagtgtttgttgctcccctctttgtgtccacgttctcatcatttagcttccactcataagtgagaacatgcggtatttggtwttctgttccctgcgtgtgtttgctaaggataatggcctccagccccatccatgtttctgcaaaacacatgatctcattcttttttatggttgcatagtattccatggtgtatatgtaccacratttctttatcccatctgccatgcatgggcatttaggttgattccatgtctttgctattgtgaatagtgctgcggtgaacattcgcgtgcgtgtatctttatgggagaatgatttctattcctctctyctctggttgtatactcagtaatgggattgctgggttgaatggtagttctgtttttagctctgaggaatcgccacactgctttccccaatggttgaactgttttacacacccaccagcagtgtgtaagtgttcccttttctccacaaccttgccagtatctcttaatttttgactttttaataatagccattctgactggcgtgagatggtatctcattgtggttttgatttgcatttctctaatgatcagtgatactgagccttttttcttatggctgttggctgcatgaatgtcttcttttgaaaagtgtctgttcatgtcctttgccttctttttaatggagttgtttgttttcttcttgtaaatttgtttaagttccatatagatgctggatatttgacctttgtcagatgcatagtttgtgaatattttctcccattccgtaggttggctgtttactctgttgatagtttcttttgctgtgcaggagtgcttaagtttaattagatcctatttgtcaatttttgcttttgttgtgattgcatttggcatctttgtcatgaaatctttgcctgttcctatgtccagaatggtattgcctagattgtcttccagggttttttatagttttggcttttacatctaagcctttaatccatcttgagttgatttttgtacatggtgtatgtaaggaaggggtccagtttcagtcttccagagcagaactttctaacttgtgtgtgggtgttgtgccctgggcaggttaacagatccctccaactcgaggagtctgggtggctggagctctgcactggtcacctttggggtgagtagcctggccccaaagtgacatacaaacatcattttctgtgtgtgtcacagcctggagaaaggtgagaagtcccagatgatatcagtctaagagttttgtacttgacagaaaaagagaacaaagagccagtctggaggaaatcagcaagtgccttacatttttttcccaagctaggcttggtggctcatgcctataatcccagcactttgggaagccaacgtggaaagatagcttgaggccgggagtttgggaccagcctcggccaccgagcgagaccctgtctctacaaaaaataaaaatgaactgggcgtggtggtgtgcacctatcatatctagtctttggactagaaaaatctaaaatggtttggtaagactttgctgttgctttaaagcaatggtccccaacctttttggcaccagggaccagactggttttgtggaagacagtttttccactgataaagttgggggtatggtttcaagataaaactgttccacctcagatcatcaggcattcgattctcatacgcagcatgcaaccragatcaccacgtgcacagttcaccgtaggttcactctcctacaagactccaacgctgccactgacctaacaggaggtggagctcaggcggtgatgttcgctcacctgctgctcacctcctgctgcgtggcccarttcctaacagaccacagacggatctgctggggactcctgcatataaagtaagtgtgtttggagggaaagtaactaatttaaagagattcccaccagccaattagaacaagaagaaaaaaaaacatcagcaaattgaaatatattgtttgtaaaaagcccaagctcattaataagttcagatgaggcaaacaagatgagccttaaaaaggcacaaaagmattcagtaatgtttgcactgtgtctaggattgctatggaaaaagtttagttattatagcttcctgggctaacaaacacagtagttgtaaaaaccaacttaaaggcctaaacattcaacaaaaagaccaagttataccatacaacactggtctatgcaactcagatagaggaaaactccgtatttcattttaaggaaggacatcaggctacaagacactgaaatttggtgtttggttgaggccttataaaatctcagtgaaggcaggattggagctcaaagctgccctaactagtcagatatgcttggcatcaaagagtgtgtgccctgtgctgagaaactgctttgatgcacaaagaccatgaaccagggagccccaccctgtttttacagaaagggatgatcccttaggatttaaccccataagattaattttccccataggaaactgttaaaataagcattagtgttaccttaggaaaggaataggaaaatataacaaagataaaataattaaatctgtgatattaatgaataacttttgctagacataagtacaggtatagaaataagttttgtaatcattgtactgtttgaaagtcttaggagaggctagcttactagatttatatgtcttgatttatcagatttgtagaagttcaaaagtctactaaggtttgtgcaatttgtaagtttgcataaagcattaaaaaattagacatattaaaatatgtcatcaacacttaaataagaaaaaataatttctttgccctgtaagcaatgtgctgtgtttgagaaaaaaaattagtctgaccagcctgccaaactataaattggccatgtattatagtagggaaacttgtccccgtctatgaacatttctcttcggcgtgaaagtcgcgcatgctcagcagcatggtgacagacggagggagaggaaaatgcagctggtagattattccttgtgtcgaagcatatgaaaaaagtactgaaagggtttgactgacctgtagaacatttggggagaatttgaaaatacatagtacatagaaaactaaggaaaggggggaaaggcactattaatataaggcaaatcagcattacataaaaaggaaatgggttcccatcccaccacctggcttagcatcgaatgctatttagtgataataaagcaaacctgtggatcgggaccgggccctcggcctctagattaggaaggcaatagataatgtctagaatttggccgggtgcctgtagttccagcactttaggaggctgacgctaaaggattgcttgaggccaggagttcgaggctgcagtgggccgtgatcatgcaactgcattccagcctgggcgacagcgtgagacccctaccctaataaaaataaatacatacataaaataaaacatgataaagttattaggtcaaaaatagtagtatacacgttatgtagaaatatggtggtaaataccagaagaaagagcaaagggtttggaagtgattgcttctggggagttgggagggctgagaaggagcttgttgtcttttataacatctcttttaacaccacctgatttttaaactgaatgtatatatagtaatttcataaaaagaagagttaaccaaccccctccataaattatatgctatagaaaatgtgaaaatccagaaaaacacaaaaaacataaaaattaccgttagaaacatttggtgtatagwatttccctctattctgtctgtaaattgtgcctacacttaccttttttcctaatttacatggataaatttaaattgtatgtatagttttatatcttttttaatgtaatcttgtgtattcccatgtcattactgtgatttttattattattagccctatttatatcccataatgttgtacataatgttttattatgtacaaaacctgtgagttttaccttcagtgaaattcctagaagtggaatttttaattcagatagtatgaatgtttccatgacattttcttttcttccttcactttattgtattttacttttatttttgacataattctaaatcatactcaggaaatactggtgtaccaatttacagtattgttactgatcrtgggttcttagattctcatgcagtggaaattgacatgagacagagaaagtgtcccagacaaggctttataatgggcttatgctggagcaggagggcagcggcacaggggcaggagttcccgggctggccctcgggacaggtgttcctggtgttttagggtgacatggatagtcatgaggtgtgtcagcagcattacacacgctagtggcaggcaccggggaacatcatgttagcacagatgtgtcatgatcagggcatggcagatgagcccctgaggagagggttttagtaatacaacaaggcaagaggtcaggatcgtcgttctgatcctgtatgcatgtgggcatcaggcttaactcccttgggtaagatttggggtggaacatggcttatcttgtttccctccctggtttgcatggtctggtgggcaggtgtgatggcgtgggggatgtatrgaaaatacgggagtgggtacgggccaagctctgtccctgctgcctccgtattacttgcatggcgtgagaaggattgcctgtctttgtcagtattagcatgaattgtttttgtatttgcaaggttcatggtttgaaaaggcatctttaatgtactctccaccattgctttttgggaaggctgtgcaccatggtgttaagagagtgaactacagagccatgcggtcctggcttccagccgtcattctgccattgttgccctgggttctctggagacatggtacttaaagagctaaggcccgatttctttgcttataaaacgtaggtgttctcagcagctatctcagagggtaagggtctttcagtgtggacctagcacatagtatatatcaaaaaagtgatatttttttctgaagttgaaacttttaaatataattattagctattgtctttcttttttgggggtaaatttgttaatgtcctttgcacgtgtttctackggggtctgtttttcctatttttttagtagcccagttackccattatttttcagttttaagagtattttactgattctggctgctttttgggtagaccatcaaattgtttgctaactgtgctcattttgtctcctttctgacaatctcctttctcattatgtttcatgagttgtatttgcctttgccagaactatctgaacaaagttacacaaggttgggacgacagatatttttatcttgttcctgtttggggagttaagggactaatgttctatcatcagctgtgctggtggctgctgaagtaggtaattcttaccttgttaaggaagcatgggaagtaccacttgctgtttgacgtaagggtgtttatcaggagtaggatattcagttatttaatgactaacatagtttctgctaagaaaattaaatctctaggacatccttgatttattgtttctttgttgctcagcaatttttatgtaaggcatagatagaattttacctttcacggctgtcagcagtgttttcaactaagaaatggaatatcattactgacctcactgtgggctttgaaaattgagctacatttttgctcttccttctgcatttggtattaacaattattgaatgttagagatggaagggaacccagattatctggtatatgcttttcctcatacagagaggaaactggtatcaggagtccagtgatttgcccagggtaccagagccaggactagagaccctgtcttcctcctgactcgtgccatctcctccgaatatcctggtctggtttctccagttcagtgtttcagattaaatcccctgacacagtaaaactcatgtgcactgacttctcctccgaatatcctgctttggtttctccagttcagtatttcaaattaaatcccctgacacagtgaaactcatgtgcaccgacttctcctctgccccagatggtgtaacctgggctggccagacaggcacctccccagtgggcgtgtcttcagacaaaggtggctttgctttgttgaagttactgatataaagatcagcgcctgaaacagattctccgggatattaccggagacggagtgttttattattagcctttcttaggtggacatttccatttgaattamaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtaagagtccttcagcatttgaggggaaaacgtgtgctgacggtagaatagtctaggatggggttgggggagcatgtgggaccttcccctggccagctgacatggtacttaacctctgtcttttttttttggtttatggaggagccatctcacctggcagcctctccacgtgggctgagccctcttggggacaaagacagaagtccatgtccccaggccagggaaaaccccacgtgtcagggtgtctgctggctttgagtcctgagacacggacttcacaggctgtgcttcttgctttggggcatctcctcttttcttattcttaacctagaagtttccctgttttaccaattgtttctcttcaagttgataagcgggcagttcttgtgatctagaatccaaagaaccaaaaataggcccaattttgcttcagttccgtgtaatggctacttttgtttatactggtgttcccagggctctgcggaatcctggatttatttatgtatcatcaaagactcccttatattcagaagaattttagtaatatgtactttctattgtccttttattagaaattagtaatcttaaaatatgtttggaaaggcttggcaagccaggagtgcccagtgccccaagtattctgtgtaatgaataaagaagagtttgaaaacaaaatatttaaacaagcacagcaaacaagctttatcaggtgtatgagttattgtcttggtttcccgtggctgctgtaacaaatgaccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctscctccctcttagaaggatacctgtgattacatttagggtcaactggaacaatccaggataatctcccatctcragagcctgaatctaatcgtgctgcacmgtcccttttgccatgtaaggggcattcacaggtcccagggattatgaccyaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgcccctgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctccsgactatccagctgcattcctgctctggaccctgctggggctgccacacccactgcacggcagggctagagagatgtgcagcctgaccctacccctgagcctgtctgtgaaggtggagatgggcatgcacccacagyccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatrtttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgygggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcacagatggcccaggtacagcttcagggcagccatggtgctattaactgtcaagttagctggtcctccttattccaaatcccaaagggatcgctcgagacggatgactgtgcagtattgcagggtgtgggtggcgagtttacagggaagggcatgccacccatgctggagcaccctggggacaacaccctgactgaccccctggggtggagagggggcgcccgattcagaggaatgaatgatttcatcatcacatggcttagcttgttcgtgagtttgtagatggttgtaaagtcacaaggttcaggttgagtcctgtgatgatctttgggtactgtcatctgcttgttggttgttaggagtctttattttctcatttacgcgtaaagccttcttagaatggcatttgtcagctaaacatgttttcagtagcgttctggttatttgttgttgtgtaaccagctctcccagcttagcagctttcctggttgttgaatctgggtggattgagtggtgcttctgcaccacttggcactgggtgggtcccttgtgggctgcgtcagcgggggctcagcggggcgctgggcgtcttctccgtggccttccacatgcttccttcagcagcgttgcctgggcttccgtaggccwggcggctgggttctgagaggaagtgctcgcagaagacaggcttgaaacaagtacccatcacgtccccgcctgtgtcctgcttgccaaggccccactgccaaaggcagaggcrtctccgcgcctgagaggggttgagagagggtgcgcacaccacagatgtagctggtcgrggccacccgtgactgctgtggtctgccctctggacytggtggttccctgggagcctgagatccaggtgtaggcagggttggtttctcctgcagcctttctcctcggcttgtagacactgttttctccctgtgtcctcacatggtcatctctctgtgtgtgtctgtgtcctcatctcctctttttatmaggacatgagtcctattggattaaagcccaacctaatggccttatgttaccttaatcacccctgtaaaggccctctctgcaaatgcagttccatcctgagacactggagttgggacttcagtgtgtaaatttgaggggacacatgcagcccatcacagtaggcgtgggaggcacgtggccgtcacggagcagtggcaattcccaagcccagccrggcatgtattrttcacctctcagccctgggtgcagggygttccttgatgagcctccactgcagcttcccagaattgtcccttgtccgytgctgccctggctgtgctctgccctctgtgtcctggtgtcgctcttggcagctcctttcctgttctgtaagaaatggcccgtgcttgctgcgctcccagcctacctcccacctgtagaacgtgggcacccagaggcctccctgcactttgagccgtctctctcttttagtccaagctgttacaagtgcctgaaaaccactgtggaatttctatcaacttaaaattctgcttccctggacaaaakcacccccaccgccatcctgagtgctctttgttgggttgggagtcagggtgccatgggagagcctgccrgatggtctrtaagatgctgtctgaatcttctaaggtttaacaaagtggatttggacctcacccttgaggccagtgtctgggatttgatctttgccctgaggccatctcttttagaatcttttgccagctggaaaggctgggaagaagaaacatttttattctccacccagtacatcctggattggaaatagttcctttaaattctgcttgaaaatggaacagttccttcatctttctcttcccatgtgttaccctaggcagcaaaaagaagccagcttcctcctggaccccttagccagatgcaggagttcccgggggaggcactccatcctccctgtcactgagggtgaccttctttccacttcttcagctggtacacacacagccccctttctccagcccccaggagtcatttcgtcctgtccgtccagcctctgccagctgcctgggtccaaggccaagtccacatgttttaggttttggtcatggcagaattccacttctggatggctgcatgtgtcagctgttgccacaaaacaaaccatcccaaacttagtggctggaaataayaatgattgattatttctcagattccgtggcctgagcaggcaggactgctcccaggaagcagtgcaggtcactcatgcagctgtttcagtggacacctggcccggaaggttcaagaaggcctctctcacacctgaaacctcgatttttwttttttttttgagacagagttttgctcttgttgcccaggctggagcacaatggcgcgatgtcggctcactgcaacctccgcctcccgggttcaagtgattctcctgcctcagcctcccgagtatctgggattacaggcatgcaccaccacgccaggctaattttgtatttttagtagagatggggtttctccacgttggtcaggctggtctcaaattccygrcctcaggtgatgcactcgcctcggcctcccaaagtgctgggattgcaggtgtgagccaccacgcccggctagaggcctcagttcttcaagcaactctctcyacaggtgatggcaccttctccagggctttccatgtggccttcrgcaggatagcctggacttccttctgtcatggtggccagggtacaagagagtgaacatggcagctgtcaggccttttaaaaagggcctaggcctggaacagcatcacttctactgaattctacctactgtatcattagtcagagccagtgacacgggcattccagagccacgggcaggagggagtctgccccttctgatgtcaggggcggcctgtgtttgtatagacaggaggtctggttggcacccttgtttgccamcagactccaagtactgagcatcaggagcctgggtttgtggagggcgttgcagctcatgccagcacagacagggtacagggaggggctttcaagacccttctggcctttaatcagatggatctttttttttttttgagacggagtctcactctgtcgccaggctagagtgcagtggcacgatctcagctcactgcaacctccgcctcccgggttcaagcgattctctttcctcagcttcccgagtagctgggttacaggtacgcaccaccaggcccagctcatttttgtgtgtttagtagagatggggtttygccatgttggccaggctgatctcgaactcctgacctcaggtgatcctcccgccttggcctcccaaagtgctgggattataggcgtgagctgctgcgcccagcctcggatagatcttttaagcagtaataagggtctggatggttgttaggctgagtttggggttgccccatttcctgaagtcagagcatacaggaatgatttgttttcattctgtttttgatttcagatactttctttcaataaaagtggcggtggtggagacatccaccagggcttccagtctcttctcaccgaagtgaayaagactggcacgcagtacttgcttaggrtggccaacaggctctttggggaaaagtcttgtgatttcctctcagtaagtcatacttgctcttattcactaaagaaataaaggtggccaggtagtgggggctggggcccagcaggaagcgtgtggctctaaatgccattatgccatacataggcttttgtaatttcttttcacctgccaatatgttttaaattctctgcatttcaataaggtggatctacttcacgcttttgaagtgtcttgtcagcatcttgtcaggcagctccttgatgcatggctgctcccttaaaggatccagcagttggtgaagttcgtttgatattcagagactgattcaacttagtgttttttgctttttttttttttkgttttttkgttttttgagacagaatctcgctctgtcgcccaggctggagtgtggtggcctgatctcggcttactgcaacctccgccttctgggttcaagtgattctcctgcctcagcctcccaagtagctgggattacaggtgcatgccaccatacatrgctaatttttgtatttttagtagagacgggctttcgccatgttggccaggctggtctcgaactcctgagctcacacgatccacccgcctcggccccccaaagtgctgggattacaagtgtaagccacagtacctgaccttgacttagtttttaagctaggattaaatatagctaaagctaggaagttgtagtttaggttaagtcctcatatttatttgtaaattatgtatgtcaatcataaaattatagattttctgacttggtgcaatgaagaagtaggccgttggtgttcatcatttttgtagccaggcagttatgtcactctgtctatcctagtcttttagagattcctgccaaaaattctaccaagcagagatggaggagcttgactttatcagcgccgtagagaagtccagaaaacacataaacacctgggtagctgaaaagacagaaggtgaaaatgtattgttattctacttttgtaataacctcttaatccattttattgtcagttccttcacaagactgtcaattgtaaacaggaatgatttttttttctctgaataactgcaaacttaaaaaatctgcttctgaaatcagttgccattatttgacattttggaaatgctcaatgtgttctgttctctctgatttctccctrtttccttggtgtacccrtgatgcctttcagtgtttggtatacctcttctggatcaatccacrttttaattttgaggagggggttagtgtgttaatgttaatatagtttttcctttcacaagtaacataaaaaattcgcagtgtggatctcaagctgcctccctcttgggtagcacagtctacagttgccatgcattgctgtgggacactgggtcacgccctggtctatctgtggttcttaatttaaactttttttttttttttttttgagacaaggtctccctctgtcacctaggctggaatgcagtgacacaatcacaattcactgcagcctcaattttctttttttttctttgagatggagttttgctcttattgcccaggctggagtgcaatggtgcaatcttggctcattgcaacctctgcctcccaggttcaagtgattctcctatctcaacctcccaagtagttgggatcacaggcacgtgccaccatgccctgctaatttttgtattttttagtagagacaggttttcaccatgttggccasgatgatctcaatctcttgacctcgtgatccacccgccttggcctcccaaagtgctgggattacagcatcaattcttgtgctcaagcggtcctcctgcttcagtctcccaagtaattgggactacaggtagcaccaccatgcccagctaattttaataaattttttttttaagagacaaggcctcactatgttgtccaggttggtctcaaactcctggcctcaagtgatcctcacacctcagcctcccaaactgctggaattataggtgtgagccactgtgtctggcctaactgttctttragcttgtaaagaacatcttctgactgcccacctttttgataatcctttaagttcttgtctttaagtcataggcacccatgattgcttcttatctcatgtgttaggaactcatcctgcataattaacgcatatttgttcactttgtgtgttttattcaattgatgatgtttttcgtaccagaagattttgttgttttgctttaaggacacgtatccctttatatttgggggacagtggaactctctatccgtgcacttgactgctgaaggagaasgccccagccgattcctgatgtgtcggggatccgcagccgcccctatctaaygcggtcttgaattcttccgctcaggtaaaattgcggagttgctctctccgrgctcagtggatccattgacaaggctggttctggtgaatgctgtctatttcagaggaaactgggatgaacagtttgacaaggagaacaccgaggagagactgtttaaagtcagcaaggcgagtaaggggccgtgacaggagcrgcgcctgtgttcacacgagcgtctccggctcggggcctcccgcgtctgcagccgtggggcctttctgtccctgcccctcctgcttgacatccattgggtggcctcgtgtccctgggcgcctggcatccgccctgccacctacagggcaagtctgaagctgcagccctcaggctcgatcaaggtcttaaagctcagactccagatatggcgtgccatcttctagcggacatttcctccttttctctagcttcattcccatcaggacctacccactcctttctttctggcggcgtcccgggaagccccgctaccgcgcctcctgctggcctccgtgccacactgcaggagcggaacaactcrgcctgctgaattgaggctgagcagggaggactctctgacaagtgccagacacgtagctggtgcttagtaaatgctgaaccgatgagtgatattcagtcctctcttgatagtaaggataagtacagatttttgttttaaaacaaccaaaccaaacatgtagatagacactgagattaaccacctccagcgtggaagatgtcatttgctgatggccctttatcttcctctcactgaatcttctttattgtctcttgttttgtttttctttaactatagaaatttttgaacatagacaaagtaaacagaatagattaattacagtgtattcttgatcattgaccatagttagatcttccaggctaacttgaacttgagccttcagtttttcaagaaatttattttcattgtctgttctcctcgcaattcagaaagaattattttctttgaagctttattctgaaatgaactgtgctattttcccctggcaaaataatttctctctttaaaatttaatgattaacaagatgtacaagggctttgactacagataacagamaccccggttcaccatggtttatctcctaggagctcatctcccctgcyaggaggtctggaggcaggtgagacctgggctggtctggcactggggcgatgatcccagggaggcggctccaccattctcagcacgtcgccttcttcctcatggtcacaagatggctgagctggcttcagcagtyccggtggcagggasggggaggaacaagggaggggaggggagcctaaaccttccccttagtggttctgcgtttcagaaagggaaagctgctttctatatggtgtaggccagaactataggtcttgtgggtttggggagatgtggaatcccgtcatgctttctgagttctgcagtgaagaagggtgaaggaaggggctgcagtattgagcgtaccagcctgaggccagaggtgtacctccaagggcacagattttgagttgatacagattcttattttaatttcattaccttctatataaactggaayttgtctatataattgtgtatttagtgaatcattcagtcactaaggttagatctttttatattgcaagattggaggctttggaccctgaaggggtgcagggaggaattactgaaggcaggggtcagcaaacttcagcctacagcaaagccagcccaccacctaattttttttaaaggtttactgaaacacagccatgcttattttttttttttwtttttwttttttccaagacagagtttctctcttgttgcccaggctggagtgcagtggtgccatctcggaacactgcagcctccgcctcccgggttcaggtgattctcctgccgtggcctcttgagtagctgggattacaggtgtgtgccactatgcccggctaatttttgcatttttagtagagacggggtttcaccatgttggtcaggttggtctcgaactcctgacctcaggtgatccacctgcccgggcctcccacagtgctgggattacaggcgtgagccaccacgcctggcccatgcttatttacttacttatttcatcctgtaacaacagctgagtcgttgtgacggagatggtacatgtagccacaaaccggaaaatagttcctgtctggtcagttatggaagaaacatgcctactgctggccaaggaaatgagtggggcagccgaggcccaggagactgctctagccaaaggctaagggccagcccaggcgagcctctaccacgtgaaagcagaaagctgccgccgcagtgtattttatttattccatttaacacagaagaatgtgctacaccagagactggggaccatacggcgtctttgactgtgcctattgcagggtatttactcaactcacaggagcagctcsgagtcaggaactgagggggattgttggatggggtgtggttcctggcctccagtctttctcattggctggctggggttggtgaccagtgcagttttttctggtgagatgtgtaaatgttgcctggcctttttagcatcccagctcattaattcgtttatgcatttatcatttattcagcagagattgactgagtgccttttttttttttttttgagatggagtctcggtctgtctcccaggctggagtgcagcggtgcaatcttgggtcactgcaacctctgcctcccgggttcaagtgattctcctacctcagcctcccgagtagctgggattacaggagcgcaccaccatgcccagctaatttttctatttttagtagaggtggggtttcaccatgttggccaggctggtctcgatttcctgacctcaggtgatccgtctgcctcagcctcccaaaatggtgggattacaggcatgagccaccatgcctaacctgactgagtgtcttctatgtatcaggcatggtgctaggtatttttcagccatgcacaaaacaagcaaagcatgcttgccctggtgaagcttatgttttcttgggggagagacagcaagcataaataagaaaataggagcatattagacagtggtaaatggtacagagacataccaagggaggggataggaatctgtgtttggggtgggagtgtagggtcaggtaagatctatcaaggacagcttctctgccaaggtggtttttgaacaaagaccgtaaagaggcagaagttcactctccaggttctggaggacaagcttactgcgtagagatgagatgaactgggtttgctggcagtgcagtgaggaggcctctgtgactgtagcagataagcaaagggagagggaactggggacgagctcttatcacaattccaggctttttagggactttcagctcctgctccgagtaaatggggagccagggaagggtgtccagccaaagaacaatgtgatctgccttaggttctaccgggcccctctggccactgtgctgggaacaatcacaatcatattatcacaatattccagggctaggctggtagcagcagaggcagaaggaacaggtcagattttgttatattctcgaggtagagccaatataatttgccagtgagtcagacacagggtgtgagagaaagacaggagtcaggggcactccagggcttttgaccactggacagtggcactgccctcagctgagatgggcagagttgcagtagacagagccgacttggaggatctacggagtgccgcattacaggtggcgctgggagtttcttttatgtccaaacataggtgcaggtgggcagtaaaatgcaggaggcccaaggacagggcagaggcccaggcgggaggtaaatttggtgtgatattgtgtttaaagccatgagactgaatgcgatcaatgagaggaaagacacgttgggtttgggccctgggcaccccagtttctggaggttgaggtaatgaagatggcagagcaggcgctgccgggtgttctggaagctggggagaaaccgagctgcgtttctccctgyagagagtggccagctccgacacatttgtcccatgtgtcagtggggtcttgtttcaacttgatgtttatctgttttctttgtagaatgaggagaaacctgtgcaaatgatgttkaagcaatctacttttaagaagacctatataggagaaatatttacccaaatcttggtgcttccatatgttggcaaggaactgaatatgatcatcatgcttccggacgagaccactgacttgagaacggtaacagctaagctgtgagcgaggcgtgctagcaaggagccactcgggggtgtctgctgtggctgctgtccctactttgcggtcagccgtttaacactggagcgctgctgaccatagccacgctgccactggtgtctggcatccacagcatakcacagggccctgctgggcagcagcaccctrggtcttaaagtcttcaactgtctccctctaggtggagaaagaactcacttaygagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcrtcccccgcttctgcgccgaccaccccttccttttcttcatccagcacagcaagaccaacgggattctcttctgyggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcactccgtgtgtttgtgtgtctgcacgggagatgtttcctaggatctgaaattgctgctctgggtctgggttatgttagtaggggcggcaatgaccacctagctcacccttgcttgggggaggtgttgcccaccccccacagccatggggaccccacgacttcattgtgggcagacagctgcccttgaggtcggtggtgtgactcttccttggcacaggaagatacatggtgcttctctgtctcctctactcagtagtggagtctcatcccacttctagggagagaatggggtgaaatggggtgctacagggaggtgcgggaagctcaattctaaaactaccgcaagctctccggaagcctgcatggaggtggggggagcaggtgaaccagatgagggtgacagcagtcccctgccctgtgggtgtttctgcttccctgaggactggtggatcacatgcttgttcacacacacactgcccacttccaaaaatgtcaaatgatggtagtgttccctttatagtaacggagtttacggcgacttcacgagtcagcaccaggtgcctttctgtttcactgaagtattgcagacagaaaagacagctaaggtttcyggggccatttgtgttacttgctggaaatgtgatccctgcacccagccatccaggagcagaaggacaggtcaggctcagatggagccacacaatgttccagggaggcagaaaggacttcttttgcaggcagtgggaacctggcctctcctcctttacctggtgcaactgtgctctcatatgctctcactcttcctggttctctttccccttagtgtccaggctggggtgacagatgggactcaggagcagcaggagatgtggcaaggatgagtgggagagctggggaaagaagggccagatagtgctggttttgtccctcatactccctgctctgcacagcattcttgtttgtttgtttgtttttgagatggagtctcactctgtcacccaggctggagtgcagtggcacgatctcggctcactgcaagctccacctcccaggttcaagccattctcctgcctcagcctcccgagtagagtagctgggactacaggcatgcaccaccatgcccagataatttttgcatttttagtagagacaaggtttcccaatgttggccaggctggtctcaaattcctgacctcagstgatccggcctgcctcggcctcccaaagtgctgggattacaggtgtgagccactgcgtccggcctcagctaatcttttgtatttttagtagagacggtttcgctatgttggccaggctggtcttgaactcctgacctcgtgatctgcccaccttggcctcccaaagtgctgggattataagcatgagccaccatgcccagcccattcctggtttgttgttgttgtttttgagatggagtcttgctctgtcgcccaggctggagtgcagtggtgcgatctcagctcactgcaagctccacctcccaggttcacaccattctcctgcctcagcctctccagtagctgtgaatacaggcgcctgccaccacgcttggctaattttttgtatttttagtagagtcggggtttcaccgtgttagccaggatggtttcaatctcatgacctcgtcatccacccgcctcggcctcccaaagtgctgggattacaggcgtgagccactgtgcccggcccattcctggtattttttaaagaacggggacaaggagacttggaacaagggctccgagggtggggcaggatccgtttatgtgatgcttccagcatcacggagagggcctctgcactgcagctggcagctgctgccctgtgtccagttcttgggcagaggcacggggtccacatccttgcttaggggcagggatgggggcagggagtggggtacgtggaatagtctctaaccatccaggtatcatggtatcattccctttccccaggataaggatggtatcactagtgagttaagatgaacattcagggtcctatgtgttactgacctctgacaggggaagagaacaaccaacaccacacatcccgctctggaaggctccctggtccccactgagttaccgccccttagctgtctgtgacatcacctttgaagggttatctgtcactcttaatttgattgcaatacagtaaaaggcacaaccatctgagtaatgcctctacatcttttaggaaatggcacaagaagacattggggggatttttgtttgatttttaaattttccattgtgaacatgtattcttgtgtaatcagaaaaatattttatttatttatttatttagagacagagtctcgcttcatcatgtgggctggagtgccgtgattcaatctcggctcactgcagcctctgcctcctgggttcaagcgattctcatgcctcaacctccccagtagctggggttacaggcatgcaccacgacgcccggctaatttttgtattttttttagtagcgatggggttttgccctgttggccaggctggtctaaaactcctgacctcaaatgatcctcccatgtcggcctcccaaagttctgggattacaggcatgagccaccgtgccggccagaaaaatatttttaaactgtgtacagggaagtaagggtttctattatatgcaaatcctgtgggattgtttgtgccaggggagatctgttctttctctgcaactcactgtatcctcacctgctcttcctcatatggctcccacccttacccgtctctcccctgggttcatgctgttcttctcatttcgattcactctccctgaaaggactcagccttcgccagtctgtgcaggcatggttctgggctggatggccctctgagctcggccaggcggctgaccgtggtcatgcagatggtggcaggatccttgggtgcactcatcttcaataagggccttggacctcctagtgttcctcctgaagctgcggtggatagtctcggggaaggagaatggaatcactggctcaggcccgcctagattgcgcacgcactgggccttggttctattcactccygcactgaaaccgtttgcatctgggtgaacagggcacacatccagttcccacatggatactgcatgtggctctcagggcacaaatcattccaatcttaacagatgcaagaaataaaagggaggaaacactctttagttcactgcatattgacgagcacaaccttggtaaggttgtgtttggaaattatgtatgggaagggaattatgtatgggaagggaattawgtatgggaagggaattatgtatgggaagggaattatgtatgggaagggaattatgtatgggaagggaattaagtatgggaagggaattatgtatgggaagggaattatgttatgggaagggaattatgtatgggaagggaattatgtatgggaagtaagcttaacccaggaatatgaggtggatgcagcatgataaaatgcatgccatctgttccattatagaataaagcagcaagatcgtagggtcatatcccttgatgcagaaatagctgtctcattctaaaggagaacacggcagctgatagacacaagccacagtcccattaattgatagggttgttttttcagtcagccctgccaaatgcaaaggctttacatacactgaataaaattacatttccaaagcaaccttttgaggtggatatcagctctattattgttgtttttaatctgtagacaaaagtttggatgaawtttttttatccttacaaaagtgttcccagtctaactaattaacctattctcttagtcatttagatacttttacagaatcaagagtaattatgttaccattattcttgaatttcacaactataaaattatacacttgggacagaaaactataccttaaagagaagaataaatgaaacagcgaaatttgatttcacttttctgtgtcatttttggagactttctggaaggacaggccagccattaggccagtaagcgtgtctattctgaccatttcatctggcgaggcacacaagttcaagttcagtttttggcaagcttgaaaacacagtaactttatgtatgtttctagtaaaataccctctttttttttttgarawggactctcactctgtcacccaggctggaatgcagtggtgcaacctcagctcactgcaacctccacctcccaggttcaagtgatgcttgtgcctcagcctcctacgtagctgggattacaggcctgggccaccacacctggctaatttttgtattgtttttgtagagacagggtttcgccatgttggccaggctagtctcaaactccttgcctcaagtgatccacccgccttggactaccaaggtgctgggattacaggagtgagccactgcgcctggccaatttcccctttcttacttaaaacccagaacctcctaatttagcttttaaaatacaccctcttgatggtcaagggcagctggggatttagctcctcaggccctcctatgcttgctccccagcccctgtctgtctgcacagggcagccagatgcacgctcatgtggctttgctaaaaggtgatgggcggcaaagggaaattaaagttgaaagtaagtgctatggcttctcagtaaacttggaggtcatttaaaataccctttttagaaataacacttcctttcccccttattcttagaggaaacagacaagcgctcagcggaaatctgattacagaacaactgcattttttttctgaaaacatagtcagaacttgtgtttttttcagtatgcgaaccctgtcacgggtgagcagcacctaccagggccattggtgctggggtaaaagaatttcccaagatagctgtaggtaaagaaaggcagatttattagagaaagtatgatgtacctcgttaaggtcgaaatgggcagaatcagcaagagaggagttcagtgcaagggaacaaaggcttgctgagggtttcagaggatggttctcggctgattgagaacgccaaggcagtagggagctcgcttgcattcttctgtcagcagaggtgtttgatgataagttgaagtgtttgatgataagcaggaagtttgtgagttacgtacattatttgcacaggtgggccatatgtcttgggccataaagaaaagcgaacctatagcttatctgctttctctctttgctttcccctggtcctgccagcctcactcctttttcctcattaggagtccacaaaccctacatggcacctacacagtagttaccagttattgaaggtttcattttccagtgtttcagttacccatggtccaaaaataggtgagtacagcactgtgggtgtgagagagagagagggagagagagagatcatatttacataactttttttgagacggagtttcgctcttgtcccccaggctgcagtgcagcgtgatcttggctcactgcaayttccacctccctggttcaagagattctcctgcctcagcctcctgagtagttaggattacaggggtgcaccaccacgcccggctaatttttgtatttttagtagagatggggttttaccatgttgaccaggctggtctcaaactcctgacctcaagtgatctgccggcctcagcctcccaaagtgctaggattacaggcgtgagccaccgcgcctggcctatatttacgtaacttttattacagtatgttattgtaaaccaaaaataaaatactttttttttttttttttgagatggagcttaactcttattgcccaggctgcagtgcaacggcgcgatctcggctcaccgcaatctccgcctcctgggttcaagcgattctcytgcctcagccttccgagtagctgggattacaggcatgcgccaccacgcccagataattttgtatttttagtagagacagggtttctctgtgttggtcaggctggtctcgaactcccgacctcaggtgatccgcccgcct

SEQ ID NO: 13302 - DNA, 16643 bp, Homo sapiens
  misc_feature (1)...(16643): n = A,T,C or G, or insertion/deletion polymorphism (see Tables 1-2)
gctggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtktktgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggmtcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcarggtcctgagggagcctggttcggggggaagagctcctakatttgggggaagacggaggcagacgccasaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctayccacgcgttgcccccaccygggggaggcctgtgtggtgtctggctggggcctggtgtcccacaacgagcctgggaccgctgggagcccccggtcacaaggtgcrtgaaaggatggagctggatgcgaggcctcaaggaatcctatgctccagggctcttgggcggaggggacaagggccggaatttatggatytgctccaagtccactgtcttccccagtgagtytcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggtkaggcttggagatggagtaggaagagaagttagaataggggtgaggttggarttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattgagttgagttgggttggggttccctgggatggggatggattgggtttggggtgagattgcaamtggtgattaggatgaggatgaatccaggaggtttcacycaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccragacactgtacactgttccttttcacccaccaccccgatccctaggtgaggagaagcrgcttgaagcagggctccattcattcaacacacatgaccacccgtgtgatcttgaacaagaggcccaatctcacttcgcyttggtttccttatctgtaaaatgagaccatcttattgctgacttcmaagggctgttgtgaggattaaatgagatgattcgtctgaactgattaaaatcgtgtctggcactgagtaaataccctctatctctggatcccagttaaaggacctaacagacactagattacsaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttakgaggcaggagttgcagtgagccgagatcgcgccactgcactccagcctggtgacagagcaagactccatctcagaaaaaaaaaaaaaaaaaaaaagatttasttstgggcttcctggtagccatggcaaaaaggcaaatactgtcctttycttagccaggtccctgatatacarcaraggctggaaytctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccmtaactgggagcaagaagtgggaggctcattgagaccccagcattgtttgggagggacaytggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaagkccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggrgssgggggggcaattgtccagcccccaggcaacaggggaagggccttggccaacatctgggtgccagcagggcaggggtggggctctgaggggataagggcttttaaaagsctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcycacagtctatcctagtccggggtgccccggctcttatctatcttgcgcggscccaccctaaacttccacccccgctcctccatgttgtcatagtgytcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgycccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccayctggtatgkgggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcakattgccattcctggttcacaggaaggaccccaaaacctctcrgaagcccacctctagccttaaccatagccctttcttttaccctttaaccaggaagccctgaaatctaactgtcccagccaagctggccccttccaaccccaatgtagggaccccaagtcacccccaaactcttcagtcsagatgctcttctttacctctcagacctggtyccctaaagctgcatcctttcctgaacctcaaaagcccaacccaggtcctgtttccctagcctaggagcccsttagccctccagattcttcctcagtgagcctctgatcctgtcccacccttggcgccttgatscctggtttccagaatccytttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggygcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccrtgttctgttccctcttcctccctcttccctgggcctgtttctcgctgtccctgtcttttatccttctcatctgcctcttttttgctcaccctgtttctcactgccctcccctccgcctttytcacccctctgtccttttgagctcttttttgctstgtctcttcatttgccttttgcactctcaaamtctttcatcttcccattcgctgtctgtatttctccataactatatctttcttcctctgtctccgcccacccacatttttctctttccctttctctctttggggaccctcccccatgctcccctgccccatccccttttccccttcccrtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaattgtatgtgggggcagactgtgtagcccaaggcrgggatggggactcctgygtccaagggagaaagggccagggaagcaggtgaggtcgggctgcagccctttttctcccgggttcgtagtctcatttccagatgatctccagtgtgtggacctcaaaatcctgcctaatgatgagtgcraaaaagcccaygtccagaaggwgacagacttcatgctgtgtgtcggacacctggaaggtggcaaagacacctgtgtggtgaggcagccctgcccccagggtctggaagggctgagggaggggactcagcctstgaactggyttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctracctgtctgcaggcactgtccwcctggaccctgccccatgtgcngkmgctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaatgtgtgtcacgttctgccatcacctatctttccagatgtggtgcacctggacccactcggctgaggctggggccaccccagctgtgtcartctcatgcctggaagtctgaggtcaccagcaggtgggraaargaaggggctgtgacaggtgcagacaaacaggcagggaaaggctcagatcccaaagggcragtcagggacgccagaacagttcactcacactaggatggaccctgccctggtggggaggtggggggcaatggaaggtctgaggctgagaggttttattgtggcggggaagccagaaaaggtacagagggatgttattgcaagccatgccttcccagggaggggcccgttctgcagaagggtggagttgcaccaaatgctgggcggtgctgtgtccacctggggacaagggtggacatcggagctgaggccggaactccgggacaagggtggacatcggagcaccctggctgagcgggtggagagtggcttcagggtgtggcctgcgaaggctgggcaccaggggcagggccacacaaactagccacactgccgagctcagcgggacgctggacaagtgtctgcagaacgggaggggatgctgggcctctggggtggaggyactgtgaggacccagtgggcagggacaaagccgcaaagggcgggccctagagcgagggctggagtttgccaccggtcccctcggagggcgtggcctgayatcagggggtggggcctcaggggaggtcgaatatccagggcgtggccacgctgaaggggttggccgggcatctggccatggctaccggtcggtgtcctgaagacctcgggtgctattccttggaggtgcttgggtctcatcctcgwgggtgtatgaaatgggaaggcccggggtgcgctcggagtcagygtctgagttccgctgtttggatgtccgcctcgctgcgccctgctgcacggcccacccgcggtagctcagccgccgcgcattcaagggctgccctctgcttcacatgcccactgggcttaggtaggacacggctcctgggagatggctaggtgggccgctgtactccgagtcccaccctaggccccacccgcttcccgaggccccgccctcctcccgaggccccgccctcaccggagtgcagcatcaagtcgctggcgtcccagcacargtaggaggtcaccaggtaggacaccaccggacttgggtgcaccgccttgccgttaactgaaaagagcgtcaggctgaagagaaatcaggagccctgcaatggggtggggccagagacagaaggctggacagtgagccctatgacccccagtaagaaaagagggactgagacatyctctcccaccctccgtgacaagcagacacacacacacacacacacacacacacacacacacgccctcacaacagacagaaagataccyggagagaggggacaaaaaaagaaagggaaacagagagtgggggagagagacatcccacagatagagtagaactgagtcagagctccccagagacatgctaagacagaggcccygaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatgggcrggaggaggactcagcacagggccacggccagtaacatgaagcccttgctcatatggatgagaactggggagagggggacaggggccccagagtcamccccagatacccctcttggtcaccctycaaagtcatctctgctgatacccacaagcagcccaacagacaaccccaaagtctggcacatcctcaaaatcacccctactcacctccccaaagtcacctcctagaaaccccaaagaaactccaatctcactcacaaggtcacccccagggacccctaaagtcatcccccagtcacacccttagagttgtcccaaatcacccctacttaacctaaaactcaattctcagacactctcataatcccacacaccccccaaggtcaccccacagaggaccccccaaaggtcatcccactcatcctcaaggttaccccacagaatcacctcaatcatttctttctttcttcttctttttttttttttttttttaagatggagtctygctctgttgcccaggctggagtgcagtggtgtgatctcggctcactccaacctctgcctttgggctcaagcaattctcctgcctcagmctcccgattagctgatactacacgcagctgctgccacgccagcctaatttttgtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgttagtatcctcagtttcactcccagacaccctcaacagcaccctcaaagttatccaagacaccacggtcaccccagtcctctccaaagtcaccctacttctgctctagtctctgctagtcaccccccaaggtcccctagtggccccattcacatgccgagaatctcctcagacatcctaatgtcatctcttgttcacacctgagagcccccacaaaacacatacagatttgcacacaagaaaaactttcaagtcaaatactctaaaaccaatgtgcccaaaagcttagttccagtttacagtggatatttatccaacttagacttccagcagaagagaggtwtacctgtttccgagatgctacatctcctccttttagccctttttctactttgtctacttttcaacagtgcaaaattgttttagccaaataggccaagacctcatctgctttgtttctggcaaactgcacatctctaatacccaacaagaaagataaaggatcatcatatatacagaasagcaacagcactctgggaagtgggggaaatatcagaccccttggttttttgtttttgttttgttttgttcrtagagatggggtctcactgttacccaggctggtctcagattactgagctcaagcaatcctccctccttggcctctcaaagtgctgggattacacgtgtgagccaccatgcccagccagttcccttagttctttctgctcattgaagagtcaagaagcagaggtcagggagaaggcaccaagccagaaaccaagaccttgaatggtgaatttggtctgcccagaacagcagcctgacatctcttggggacaccctccacccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaragcagtctctcctcaaggattacaagcctgaagctgcctaagccttggacctagcytcatggggagagtaaaactaagaaggaaaacagacaagcgaaagagcattgagctgacactgaagtccctggctctcgtcatcccagagagcagcccactctgtgatttggtcagaatgagtggatatttgcagcttacctccccaccatgcatttcacctcctgcccattccccattctcagccccagtcwtaagccaatcagccaactgtactccactggccatataattggctcggggtgctcatgtgccccaagccacacaggattcttgcaagaactgttgataacttttttctaccggactcrgcagttattaccaactctgccaagttgctaacaactctrccagttttttgtctgtctgctctcagatccatttcccrccctgycytgttctgcactgcaaggaccacatttcccagcctcctttgctcaccatcttatcactgtgtttgactaatgggaggcactggcagaagactggttctgggaggagagggcaagccagggtatttatyagcctctctatctctgcatgtggtgggtcttcmgtagtagttgtatctattctctgattctagccacttctgagcaatccaaccatgaacctatgcsttccagagggctgcagtttctggactgtagtaataccacctcctccctttgtccttctggccaagtagcagyatcctgtagttcctaactcctggtttgcctcactatttcctattggcttctcagctcctctgttactcacgaacaaattccctgtatttacttccttctgaagaatctggaatgatttattttccttactggattctgacttgccactacacagagccttgagaatgaagccaatcccatagccaaaaaacagtaatatctgatactatcacttgggcccctggatccacccatgcctgaaggcattcctaccattaccatttttcactcaggtgatcccataaaggatcccctagctagttcaagttagttcactcaagctaatacaactagttcactcaagctagttcaagttagagtttgtgtcacttgtggctgggcacgatggctcacacctgtaatcccagcactttgggaggccgaggcaggtggatcacctgaggtcaggagtttgagaccagcctggccaacatggtgaaactccgtctctactaaaaagayaaaagttagccgggcatggcagcgggcgcctgtaatcccagctactccggaggctgaggcaggagaatcrctcraacccggggggtgaaggttgcagtgaaccragatcacgccactgcactccagcctgggtgaaagagtgaaactccatctcaaatttaaaaaagtaaaaaataaaaaaaawttaaaaaaaaagagtttgtgtcacttgtgacccaaaaactcctgactaattcaagtcccttccttaggacagcagggagcacagaattcaatgttccctgcataccaactccaaaatcacaatcaaaacctaaaaataagtaatgagaatttaaaaaaacagaactgaatgytcatcaaaaatctggagggagaacctcccgaagccaagaagcaattaataaagtcacagagacaaaggtgaagaaattaaactacctaaaaattctaaggctgggcacagtggctcatgcctgtaatcccagctctttgggaggctggggtgggcagattgcttgagcttacaagttcgagaccagcctgggaaacatggcaaaactctacctctaccaaaaaatacaaaattatagctaggaatagtagcrctcccctgtagtcccaactacgtgggaggcagaggtgagaggatggcttgaacctgggaggcggaggttgcagtgagccgagatctcatgccactgcactccagcctgggtgatagagccagactttgtctcagaaaaaaaaaaaaaaattctagatttctataccttaaaaaataataataagggccaggcgcagtggcttatgcctgtaatcccagaactttgggaggctgaggcaggtggatcacctgaggttaagagttcgagacccgcctgaccaacatggtgaaaccccatctgtgctaaaattacaaaaaaattagccaggcayggtggtgccaattacctacaattcccgggtcagtatccaagaccctccaccagccaggaacagtcacggggtcrgtatccaacagcctccaccagccagcagcaatcgcctggtcagtatccaagaccccttgccaattattcacaatcaccaggtcagtatccaagaccctacaccag

SEQ ID NO: 13303 - DNA, 201990 bp, Homo sapiens
  misc_feature (1)...(201990): n = A,T,C or G, or insertion/deletion polymorphism (see Tables 1-2)
ttaggagggctttggagaatggtttgctcatggtggcttttaaaatacactgagggttgccaggctgaatgggatccctgcggggctggtgacctggttctaggctggtgctcagcagagctgcctcctggtgggttagtggacttgtkaaacatagttgcctctcctattccctgttcttgggggatgaagaagaaagtcttgtactctatcccttcccattctaaaattggggtaacggaggcccaagagagtaataatataagaaataagagccaacacagatcactttatgttaacttgtctacaaatgtcaaggggaggaacatcatggcatagtggcaagaaagatatagttttagatcctggtttttgccagtctgaaactgtgtgaccttgtgtaagtaagtaagcctgagactcagtttccttatttgtaaaatactgatgatgatgcctattatacagcattgttgtaaggagtagaaataatggatgtaaagtacctggatgagtgctggcatccagtgggtacctgataagtggtctgtatttatttatttatttatttatttttgagatggagtctcactctgtagccaaggctggggtgcaatggcacgatcttggctcactgcaacttctgcctcctgggttcaagtgattctcctgccttagcctcctgagtagctgggattacmggcatgcaccactacgcccagtgtgtttttgtattttcggtagagacagggttttgccatgttggccaggctggtctcgaactcctmacctcaggtgatctgcacctgcctcggcctcccaaagcgctgggattacaggcatgagccaccgtgccctgccttctttcctttttttgagatagggtctcactctgtcacccaggctggactgcagtggtgcaatctcggctcattgcaacctctgcctcccgggctcaagtgatcctcccaccttagccccccaagtagctgagaccacagggatccaccattatgcctggctaatttttgtattgttttgtagatggggtttagccatattgcccaggctggtctcaaactcctgagctcaagtgatccgcctgcctcggcctcctaaagtgctgggattacaggcatgagccaccatgcccagctgtaaaatttttccttttagagaacagggtcttgctgggtttgccagactggagtgcagtggctattcataggcaatgaccgtggcatactatagcctggaactcctgggctaaggtgatcctcctgcttcagcctcctgagttgctgggactacaggcacccagcagataaacaatgttttgtaatcatgcctgacagtaagaattttccaacggctagttaaaaatacagattccctggccaggtgtggtggctcacgcctgttatcccagcagtttgggaggccgaggtgggcacagatcacttgaggtcaggagttcaataccagcctggacaacatggagaaaccccatctctactaaaaatacaaaaattagccaggcatggtggcgggcacctgtaatcctggctactagggcagcagaatcacttgaacctgggaggtagaggttgcagtgagccgagatcgggccactgtactccagcctgggtgacagaacaagactttgcctaaaaaaaamaaaaaaaatacagattcccaggcttcaccctctacagtctatggaaaggcatgggaatctatattataacaagccattgagtttctttttctttttctttttttgagacagagtcttgctctgtcacctaggctggagtgcaatggcgtgatctcagttcactgcaacctccgcctcctgggttcaagttattcttctgcctcagcctcctgagtagctgggattataggcgtgtgccgccacccccaactaatttttgtattttttagtagagacagggtttcaccatgytggtcaggctggtctcagactcctgacctcatgatctgcccaccttggcctcccaaagtgctgggattataggtgtgagctggcactgggtggcttctatgaggaagttttggaatgcatccaggagccctccactccaggttcttggtttattagccttttggtcctctatttatctagccctctgttcagtaaagctttaggtttgtttgaaggagacatgattagaaggtcaaatattgtatattctcaaggcgaatgtgtcctgaactttgcatagtagaatttattcctgaaaagttgtttgcagatggaatttgttttgtgcgtgagagaacaggcatatacagaataccttagtttgctatttaatttaaatcaatattatctgagtgactgttatttgctgaggatacaatgataaacaagatgcagaccccatcttcaagggtcttagagtccagcgaggaaggtggtcaaataaacaggcaattacaaaattgtggttagataaggttaagcacagggagctatggtggatggaggaggaagtgcacccaactcagtgttggggcatcttggaatttctaggtgaagtgacatgtgatggagaaacctatagactggaatatagtctcaaatccattgcaaagggaatgatccttccccaacttatcttcgtggaaaaataaactttctttctttcttttttttttttttttttattgagatggagtcttgctctgttgcccaggctggagtgcagtggtgcgatctcggcttactgcaacctccgcctcccaggttcatgccattctcctgcctcagcctcccgagtagctgggactgcaggtacctgccactgcgcctggctaattttttctacttttagtagacgggatttcactgtgttagctaggatggtctccatctcctgaccttgtgatctgcccacctcggcctcccaaagtgctgggattacaggcgtgagccaccgcgcccagccgaaaaataaactttcacatcatgttacccctggatacatttttgtggccatgcatctgcacgaatattcaatccctgctacaggcaagacactgagtgggaygttgcagggctaccaaggtgaggaggtcccaacccctgtcctcaaggagttgatgtaacacctacccaggattaatttcatttctctcagaggtcattaatccagtgtgatctgtttatggctgaagaggtagtttattattcaggtcttcactccctttcctgaaaaggctgtttattttgtttcatcactgtgcagtggcgaaatccagttccaaccaatacttaagctgggcatacattttacccaggagaaaactgaagggcgtgcaggagttcacagagctgtttgctgacccaagccatgaatctgtggagacctgggtcggtcttcagggttagtagggtctgtagggtctgtgaggatccgaggcagcctgcagacctactatcatcttctttttcttttttataattggcaatcatccttggctacccagtagcatcttttttttttttttttgagatagagtttcactcttgttgcccaggctggagtgccatggcgcgatctctgctcactgcaacctctgcctcctgggttcaaacgattcccctgcctcagcctcccgagtagctgggattacaggcatgcgccactacacccagctyattttgtatttttagtagagacagggtttttccatgttggtcaggtggtcttgaactcccgacctcaggtgatccgcccaccttagcctcccaaagtgctgggattataggcgtgagccactgtgcccagccccctggtagcatcttaaatcaagctttccttccctctgggtatcatggacatgaacaccttttatgtctctgcctcaagaggggaggaggcacagaggaacaaaaatccttgtgaattatgataattacatagtgtttaaatgaagggtggcaaggtgtgtaagtccataggtaaggkttcttttttctttttcttttcttttttttgagatggagtctcactctgtcacccaggctggagtgcagtggtgcaatcttggctcactgcaacctccgtctcccgggttcaagcgattctcctgccctcagcctctggagtagctgagatwacaggcacgccatcacgcccagctaacttttgtatttttagtagagatgggttttcaccatgttggccaagctggtctygcactcctgacctcaagtgatctgcctgccccggcctcctgaagtgctggggttacaggtgtggtgtgagccaccacgcccagcctcttcttttttttttttttttttttgagacaggttttcacgttattccccaggttggagtgcagtgttgccatcttggtttactgcagcctaggttcaagccatccttgtatcggcctcccaggtagcttagtctacagctgtgtgccaccacacccggctaatttttgtagaaactgggtttcacccygttgcccaggctggtttcgaactcttgagcttaagtgatctagtcaccttggcctccggaagtgctgggattacaggcgtgagccatcgtgcggcctggcaaagtttctttatcctcagtgcttgtctgggtgtgttgtctggtgggaaccacttagaccctgtaagtgaatgtgtattcccatcttgtagatggtaacctgaggcccaacgggtgtctggaggtagtgttggacacctcgtggtctgcatcttgctgcacacagaatccagcctagactcattatcctggcctttgaagtctcccccagtatgaatcccccagcctcccattcctgtttctccgaaggccaagctcgaagcatctgctgcctcgtttctgccaagttggccccacctcctgagacacttctcccctctactggcctggtgaaactcaacacatccttcaaagcccagctcaggtgtcacctctctcctggttggaattaacctcttcctccttagcactctctggtttggccctttctcttgcggcttctcctgggcaagtggcatagcctccctgatcctagtgtcttcctctgtgcatgggcacaggagtaatatctgctgtgatctttaactcctgtcagttcattgacctctttaacaacgtgatgaaagcttccagaagagctaatgtatgtggagtcccacgatgtgtcaggctaggtgtttaggactttactaactactgtctcgtttaatcgcgaatgcagtggacctctctctccacacgtcctagtacgatctttatttcacacgggaggagaggagggtgggtggggtcggccagagaggagaaatgcgtctccagagttcacagggctggtactaccagcagagccccgtccaccatatgccacagctggggttctaatccctggactggcttgtactgggctctctgcctccctggccggcgctcgggggctgggggacagaacacaatgtacagcgtgccttctacaatttcggggttcacgcacccccaagcccacccagggccaggtcaaacgcgccttcgccgggttgctgtctacaatcaggcttggctgcgctctcagtaggggtctcggtcaacctctgcccacccgaacccggcgccgtggacctggtgtgaggctggggagcccgtcctgaggggtgccggctcgaggcgctagagccacggagcctggtcccgggctccaagtcccaggaatgtgggagggctgggcggaggggcgggcgaggcgggagcgcttcctctgcccgcgggaggggatccgcggccggctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccaggtaagcgccgggtgggctcgggcggggggcaggaggctggggcgggactggcattgactgcacctgcccgagcgtacccccccggggggttccggggaagggggcgggggtccggatccccggatccccggaaggcgacttgcggggaccccggccggcctckcacgccggcgatcgatcccttttccggctgcccaggatcgggggagagaggcgggatccgggtgccgcggtgcccgagcctcccggggaaagcctccgcgcgggctccaggccgtccctggcccggctcttcccggcgctgggcacatctggcgggcacgggcccggcttcctagccrgaggmggccggagggggcgtgtttgcggaggtctggggacgcagagccgggcggcctggctgagcctttgccgacagacctccgacccggcctgcaggggcccgaggggcggcgggggcgacagggcagggccaggcgctgggcagtggggccctgggcgaggcgcgggactccgggccgagggccctgttcctggggaaagttcccaggccggggaaaaggtggccgcacgctggcttttctcaaggcagccggccctcttggcgtcgtgcttgatttcatgggtgtttaatwygtgctttgtgggcgctggctccccctccccaccccaccctcaccctcttttctggcttcacttttcagataatgctgtccctggcgttttggtgaccgacctttccccttcctggcatttccataggggctgaggcagagcagytgaaggggcattcccatttcacagatggggaactgagggagagaagtgaaakagcggagcacccagcccgtgccatgggagctgagccagcgggcacgtcctcttagcctctggagcctgttggggtttgaacccgcaggggaagcggtctagggctgccttgctgtgcgtttctgcaaatgaccatcttgcttgttttatacagacaccatctctgaggaaatgagttattggctggggatggaacctggtttcagggaaaacttctccagcgcgaatacaggagagagcagaagcatcaccctggggcagcaatgccgcctagcaggctgtaggagaagggggctggggcctgggggctgcgtgaccctcggcacccaagggtctctcctcgcagtttccccagcaggttctgcacaggctctcctgggggccagaaggcaatgtgacctcctgcagagaacctgggagtagatgtcaggagactggctccagggccgggccacagggctggacttgctcttcaggcttctctaccctcagttaaccgcatctgtagaatgagtatagcaccctctgcccaatggaattgtttgaggggcttccactggccaatgtctaaaagaactttgtaaatattaagggtttccacatgggattctcattattaaggtacagtgcctgtgggggctgtcttctccctgtccatgtaaggaaattcagggaagcagtgtctgaagttaaaaaagccttgtatttgaagatttcttgtatcaaaagtttatgctaaaacaaaaaccacaaaaaacagaaaacccccaaacttaaagcttcatttatttttaaatgtataatatatgtaattttttttttgcttcagcaaaaaaattttaaattatatatatataaaatttatttatttttgctccagccatagtggttgctagctgtgttctcaatcagcaaaaagtttcttgggtaaatttattgcttgctcaatccttccttgtatttcattagcatattgccactctacacttgtcctgtatttagatatttccttcctctatggtttgttctgtagaacctcaaaaggactctcttatttcttttttttttggacacattatgaaataggaagtctaaaaggctcccagaagaagcatcttcaaaatccacattcagcagttcattttgataatggatatttcagggaatcagtgcatttttgagctggaccagactttcaagayagctgaaacccctcagagctcttagatgaggatattgatgtccagagaagacagggagcaggctgaggtcacccagcaaggtattagagaagacaagatgggaacctgggtcacckgcctgggcctcatattttcaaagtgctatttttttttttcccgtgttttcactttgatcttacttttaatgatagggacgtatcactgtgtcttctcaaaatggtgggtgtgaatggaatttttcaaagttgaatcaatttgagatatttctgaagtttgtttaggaaacaagtatgtgactaccttcctaagagctgactggttttttgaggcctggattgtgtgtgtatgtgcttatgtgtgtgttataaaatggaatcaactataccaggttaaacaaatggacaagtcatggaaaagacacagctctgtttggacattaataagggcgggtgtggaagctggaaagctgagatgccggaaggctcagtgcttagtaggcccggaaaagcaatttttgaactggcatctcattccccttttctaagacaggaaggacggtcagagatgattcyaacatgaggactttgctagttgcagtgtctgactcctcccattctcatagcagttttgcacagtagttttggtttgtgtgtatgttttaggcaatgtgacaaagcagttttcctcctgcctccttgagaaatttaatcctgacaggttctttaagaaatcagcttgatgtgggctgattttaaaagaataaatgaaaaaaaaaagctggtgactgatagctgttttattggtcttgtagtgttttggttttgttttatcttcactttcttgtttcctggtgaataataactgggtttattatctctcatggctaatccttaagcctgattccttacctgttccatccagagtacaaagtatattttgactcctctttaaactgcttgttagattctcatatgagtgactttaaatatttttgttttgcttcaggacaacgggaaaaccaaacgattatgttttgtttgcagacagtttacgaaaacagcaaattggtttatggttagaccgtgactttgagctgacttcaagttgggccccacgataaagataaccatggaatacccaagctttcctaagcagagaggatcctggcttccaaatgagcaattttggtcagcaaaggggttatttagctcctaaaagtaatttttgcttgaggttggggctgaggcagagtggctgaacaaccgtaggcctgggtgtagccagaggatcatcagtaattacttctcagttcattcacttcttgggctagggaattattttgagtgcaggataagaggcaattttctgtgtgtttcccttctaatataatgccactgatgatattataattaataggtaacattatgcatgacaggcactgtgtgctaagggttttaatgcattatytcatttggccatttcagaaataccaagaggtaggtgctgttcttgtttatttgtttgttttttttttttgatagggagtcccactctgtcacccaggctggagtgcaatggtgcaatcttggctcaccgcaacctccacctcctgggttcaagtgattctcttacctcagcctcccgagtagctgggattacaggcgtatgccgccatacctggctactttttgtatttttagtagagatggggtttcaccatgttggccaggctggtcttgaactcctgaccgtaggtgatctgcctgccttggcctcacaaagtgcagggattataggcgtgagccactgtgcccggcctttttttttttttgagatgaagtctarctctgttgccaggctggagtacrgtggtgtgatcttggttcactgcaacctccgcctcctgggttccagggattctcctgcctcagcctcccaagtacctgggattacaggcacgtgccgccatgcccagttaatttttggatttttattagagacagggtttcagcatgttggccaggatggtcttgatctcctgacctcatgatctgcccacctcggcctcccaaagtgttgggattacaggcrtgagccaccgtgcccggcctgtttttgtttttaagagacagggtcttgctttgtcacccaggctggagtgcagtggtacaaacgtaattcactgcaatctcaacctcctgggctcaagggctcctctcgttttagcctctcaagtatctgggactaaaggcgtgtgctaccattcctggctaatttttttttttaatagagatggtgtctcgctatgttgcccagtctggtcttgaacctctgggctcaagtgatctgcccaccttggctccccaaagtgttgggattacaggcatgaaccactgcacccagccatgtttttattttatctgagagaaaactgaggttcagaacttaactgtrtacttctggaatcttcacagagaaataaaaaaaaagaaaaataatttactatagattcattaactactacgtggcggagccagggctgatgtctccactgccccaatttaccatcctgtgctgtaaaaagtcatggagaaggttttctgtgtgcagctaagagaggaggtggcagacatttatttatttatttatttatttatttatttatttatttatttatwgagacgaagtctcactctgttgcctgggctggagtgctgtggcacgatctcggctcactgcaacctccatctcccgggttcaagcgattctcctgcctcagcctgctgagtagctgggattacagacgtgcgctaccatgcgcagctaatttttgtatttttagtagagatgaggtttcgccatgttgaccaggctggtcttgaactcccaacctcaggtgatccgcccacctcggcctcccaaagtgctgggattacaggcctgagccaccgcacctggcccagacattttttagacagtcttgctgtgttgcccaggctggactcgaactcctgggtccagttgacatccctcttcatccttccaagtagccaggactgcagggacatgctacctttattttgggttctttgtgtcctaaaccctgtatgatctgctccatttgtaacacagagaacccaggtgccctctttcctgcttatatttctttggggcctcagtttacaaggcaagtctgcctttgtggagatagactggggtctgggatggaaagacctgggtttgggtctttgctctgccactgcataaactcagcaagtcacttaacctctgtgacttctcatttccttatctggaaaatgggactaacacttcctgcttcactgggtggttgagaggatcaaataagatagaaaaggaattgctacgtaacacctaaagcaaggcccaactgctagttgtggctgctgctgttacttggagagaagaaatgaggccccagatcattagttcatatgacaattttttctttttttaagacggagtctcactctgttgcttaggctggagtgcagtggcgtgatctccacttactgcaacctccgcctcccgggttcaagcaattctactgccttagtctcctgagtagctgggactacaggcacgctccgtcatgtctggctagtttttgtattttagttgagacggggtttcaccacattggccaggctggtctttaactcctgacctcaggtgatccacctgccttggcctcccaaagtgctgggattacagtctgagccaccacgcctggcccatatgacaaatatttatgaagtgttttccacagagtagtatggaataactctgggtgtgtgcaagatgaactgagctcagtcacaatacttttttttcccctaatgttaagaattattggctgggcagggtgactcattcctttaatctcagcactttggaaggcagaggtgggaggatcaggtgagcccaggagtttgagaccagcctggatgacaaagtgagaccttgtctatacaaaaaattagctgggcatggtggtgtggacctgtggtcccacctacttgagaggctgagttgggaggatggcttgagccctgggaggttgaagctgcggtgaaccttgatagcgccactgcactccaacccargcaacagagtgagaccctgtctcaaaaagaaaaaaaataaaaaataatttattttagggggtcttagtaaagaaagacccccaaaagtccatgattttataggtcgaatgaggtgaaaagtggtatcatgataaataaatttgtttaaatatcataaaaagttggtctaaagaaaaacattgggtaaataattatgtgagtatgatgtggttatgaccaaattgtaaagatgatcagtttcttaagtctgggggacaggcactgagcagaggccgtggtggggaacaggagcctgtcttcatggctcttactggccactgggcaagactcagatagyaccaaccaaccagtcacagttgtgatgtaggatgtgactgtgaatgacatccctgctgccygcttcagagaaagggctgccacttgccagagaaggaatggtgataatgagggacagccagtccctaagtggagatccctgaaagtggtgaatatcttagaccagagaagcccagagcagtttttttaccaccttgtatggctggttttccagtggctttactggtgccccctcggaggacaggggctgtaggaagtttgttattacttccttattagtgacagctgcagtcatcctattgtctcagaatttccctggcatgtaaatggtaggataaggggtggtggtaagcagatggggggcattttgaaaacgaggcagtgtcagctcccacagaaggtctaattttaaacatgcaaataattttcagttccacttttccttcttcctgttagagggaagytgtcccctgttgccatttctgaaacttgggcggacaatgtcgttattgtgttacaaacgatttgcgtctccagggcaggagttgggtgatatttttctgggagcctgtgccagggcgtagcccagtgttatctcatggtttctgagtgaatgagtgagtgagtattaaaacttcatatcaacatggagcctataacacagtggttctgaatctttcttgggggggaaaagaagagatacaagacccctagagagtatagagagtatgtaaaagggaagaatccttccccaaaagggaatgcacatatttacaatattgtatccaatttcagaaggtttttttaaaatttttaattttattgttttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtmtgaaaggtgaaaaattgkatcttgttttttttttttttttttttttttttgagacggagtcttgctctgttgcccaggctggagtgcagtggcgctgggctcactgcaagctccgcctcccaggttcatgccattctcctgcctcagcctcccgagtagctgggactacaggcgcccgccaccaagcccagctaattttttgtatttttagtagagacgaggtttcaccgtgttagccaggatggtctcgatctcctgaccttgtgatccgcccgcctcggcctcccaaagtgctgggattacaggtgtgagccaccgcgcctggccgtatcttgttatttttatttatatctttaattttgagttagttgagttttttggtcatttgcctctgcttcttcttctttttttgttttcyttttttttttgagacagagttttgctcttgttgttcaggctggagtgcaatggcgtgatcttggctcactgcaacctccacctcccaggttcaagtgattctcctgcctcagctttctgagtagctgggattacaggcgtgtgccaccacgcccagctaattttttgtatttttagtagagatgggacttgttccttaggaaccatgttggccaggctggtcttgaactcctgatctcaggtgacccacctgcctcggcctcccaaagtgctgagattacaggcgtgagccactgtgccaggccccattttttgttttttggttaactccctgttcattaaaaaaaaaaaatctrtatctatagatagatagatatagatataatctttgttatcaatttgtataagctctttggaaattagtccttcgattgtcatttgtattgcaaacacattccscctcccccatgccaattattttagatgtagcacttgttccttaggaactcagagataaataagaccctagggtggtgaagagagcatagaatttggaacaagactcctttgttggagtcttggctctaccacctcattagctgtgtgatcttgggcaggtatcttgacctttctgatccttgctcttcatattccaaaaatgctaataataggagtacctctgacacagggtagttggagaagctaagtgtgatcatattatgctaaaattccttgtaaatggctatggaaacataaacacagcattttataaaataccacgaggtattccatttactgaagagttacatcagaagagtatttctgattgtgccactgcactccagcctgggcgacagactgagattccatctcaaaaaacaaacaaacaaaaaactagccagtcatttataagaatgagttacagctataggtgcaggcggtaaatactctccaagatatctaaataaattaaaaggctatgtagaraacaatgtatatataatgttacctttaaagtgacaaaaaaaggtgaatatagatacttgtgtatcagaagagagaggtattccatttactgaagagttagggcaaagaccataatattgtaattatcaataattatgaattgtcaaaattatgtcatgaaacctctttttttcttttttttgagggggagtcttgctctgtcacccaggctggattgcartggtgtgatcctggttcactgcaacctttgcctctgaggttcaagtgattcttctgcctcagcctgggattacaagcatgcgccaccatgcctggctaatttttgtagttttagtagtgacagggtttcatcatgttggccaggctggtctggaactgctgacctcaagtgatctgcctgccttggcctcccaaagtgttgggatttttttttttttttttttggagacggagtctcacccagtcacccaggctggagttcagtggcgcaatcttggctcactgcaagctccacctcccgggttcacgccgttctcctgcctcagcctggctgggactataggcgcccgccactatgcctggctaatttttttgtatttttagtagagacagggtttcattgtgttagccaggatggtctcaatctcctgacctcatgatccgcccgcctcagcctcccaaagtgctgggattacaggcatgagccaccgtgaccggcggaaagtgttgggattacaggtgtgagccaccgcgcccggccccatgaaacctcttatattgggtttgagattaaatccacaatggattgtgtgtattatatatacasacacagacacacgcaaatgtattaaaatgtataatatgaagcagtggaacttccctgatagcacaatttaaatatttcctttttgacaaacgtgcatagttaaataaattaagtgaccaccaggtgtgactgaagagtggccagtgtctattcctagccccgaaggagcacagggatattgactgtgtcccttaaaaaaaacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttagcatgaaaaaawccctcaacagatattggctgctattttattatcttattrtgctgagacactggcataatttacaattcaaaaattaaatttttttaatcttatactgtagtttacaaggccctttcacatatatgagcttgttcaatcctcacagcgtccttgagtttgtcattgttattgccatttaaaaaggtatgactcagagtggctgtaattgacttgtccaattcaggtttcatctgtcttttgcagaataataatcatgtacgttcatagtataggccacctctttttttttttgttttttaagacatagtctcgccctgtcacccaggctggagtgcagtggtgcgatctcagctcactgtaacctccgccttctgggttcaagcgattcttgtgcctcagcctcctgagtagctggcattacaggagcccgcccaccatgcctagctaatttttgtatttttagtagagacagggtttcaccatgttggccaggctggtctggaactcctgaccttgtgatctgcctgccttggcctcccaaagtgctggaattacaggtgtgagtcaccgcgcccaagtataggccacttttaagaattactcagagttagyttataagaggcgaatcagtggagtcctccagtttggttcacacataattattaggttgaaccatataaagttactgtttttggtcctgtgaatattagtatttatatatggttccaatctgatatgttccagaaaatacacacttaagtaaagtttggaaaaccaaatcatagacttacatactgtaaggcggtgtatttgaaactgggatgtaaaatcaatttagtgagttatgacctgcattaaaaaaatggtagaatatcagagtttgctggtaagtattgtaaaaataccagagtttgctggtgagtattgtccatttcagttatatatgtgcgcacgtgtgtgtggtgtgtatgtgtgtatactaaattgcatataaaatgaatttcttatcatgggttcacctgttgccagaaaacactggaagtcactgttccagggaatggaatggtggaagatgcctggtgggggatggaggtggattctgtttccagacacagtaaaaaaaaccagtataaagtccccaattatgcattgtcagtgtctctatgtgtagctggaaaccattcctgcagcaggtaagcaggaagaaccaaattgtcgagaggcacttcaggaagggaagtgggccgactgaaagctttggaggcctgcctttaagtagctgcttttctggaaacttcagggtgaccagcctagtgaacaagctatgggtcagcgttgtgtgttcctttggtaaatggatttggtagagagctaacactactgcatttgtagtttatttgtttgtttgttttctttttgagacgagtctcactctgtcacccaggctggagtgcagtgttgcgatctcggctccctgcagcctccacctcctgggtttaagtgatcctcctgcctcagcctcctgagaagctgggattacagatgtgcaccaccacacccagctagtttttgtatttttagtagagacggggtttcatcatgttggccaggctggtgttgaactcccgacctcaagtgatcctcccatcttggcctcccaaagtgctggggctatagggctgagtcaccgtacccagcctgcgtctgtagtttaaatgataacttaatgaccaccatccagtagctgaggctctaagagggaggtctgaatagtgggtgactcagctcagccctgcctgacctctagctctaggctgtgctgtctctaggctccggcactgatttgcatgggcctgaatgaaccttctggagattgttagcccaactggctgaaggatcctgatccccaggttaatttgattcccatcaaacagttcatttttttttttttttgagaggcagtctcgctctgttgcccaggctggagtgcggtggtgggatcttggcccactgcaagctctgcctcccgggttcaagcagttctcctgcctctgcctcctgggttcaagcagttctcctgcctcagcctcctgagtagctgggactatatgtgcaggccgccacacccggctagttttttgtattttagtagagacggggtttcaccatgttttccaggctggtcgtgaactcttgagctccggcaatccacccgctgcagtctcccaaagtgctgggattacagttgtgagccactgtgcctggcctttttttttttttaatataaaaaaattgaaaatacagataaaaggaaacaaaattacctgtaatctccactcatccaggttaactcctggtacctttttgatgcgatttctttgtctttttaaatgcatgttctgtctatttatactacaataggataacctcctacatgtgctttgtaacttacatcttttaatttttaacagttgaggtgggccgggcaccgtggctcatacctgtaatctcagcaccttgggaggccaaggcaggcggattgcctgagctcaggagttagagaccaccctgagcaacatggtgaaaccctgtctctactaaaatacaaaaaattagtggtggtgcacgcttgtggtcccagctgtttgggaggctgaggcatgagcatcacttgagccctggaggtggaggttgcttgagtcctggaggcggagtgagccaagattgcgccactgcacttcagcttgggctgyagggtgagattctgtctcaaaaaaataaataaataaataaataaaataaaaaaacaattgaggtggatgtctccctaggggtaccccaggaagccacaggataaaaagcaggcatcttgctggagggtctctgttgctcagtagaaattattttgtaatgttttttgaaaaccacaaacatggacatattatggactrgataccacatttgcatcaggatttttttttcaaccagtacagtacataacaaagaaatctctaccctgcagaccctctgggggtgtgagagcgctccttgctattctcagggtcaatgtatggcaatctgtgaaggactgacaatatattgcaaacgtttccccctgccagtaaatattcttcttttgtataactgttagctgttgcatccattccattatgtggaggtaccttaatttatctaataagtcctgtgattagtcttatagtttgttttcaaaattttttttgtcacgataggccctattcagttgactttgtgatcagctctgaacatataatctggtgattgccttaagataaattgaataataaaagtaacaatagtagctaccatcggttgaatatttatcatcaactgttgtgagcacgttgtacatattaactcatttaatcctatgacgtaggtatagggaaggaaactgaggctcagaacctctgccagctagttgtgggcttcctttgaggcacaggggagctgaatgggagggtctacataggacagggcgtgtctgagtccaggaaggacagctggacttgggccagtctcacaggtgggaaggctgtctttctgtgaggatgggtgacttgttgacctttgatcctcagagccctgatgcagcaggagtgaaatgattcccagagccacagaaaacaagagtatctttgtcttggattttagatcctggagctatcaggtggtaagaaggctgtctgacccagattaagtgatgtcatggtatcatgttggggtgtgggccttcctgttgtaaattatttgggatttcatagagatcgaagtcatgtgtggatgacatgacttcaggatgtcccattagaagaggaacgtgggggtcaggcgtggtggctcacgccagtagtcccagcactttgggaggctgaggcgggcggatcacgaggtcaggagttcaggaccagcctgaccaacatggtgaaaccctgtctctactaaaaatacaaaaattaacagggtgtggtggcacatgcctgtaatcccagctactcgggaggctgaggcaggagaagtgcttgagcccgggaggcacaggttgtggtgacctgagattgtgccattgcacttcagcctgggcaacaagaatgaaactccatctccaaaaaaaaaaaaggctgggtgcggtggcttacgcctgtaatcccagcactatgggaggccaaggcgggtggatcacaaggtcaggagatcgagaccatcctggctaacacggtgaaaccccatctctactaaaaatacaaaaaaaattagctgggcatggtggtgggtgcatgtagtcccagctactygggaggctgaggcaggagaatggcgtgaacccgggaggcggagcttgcagtgagccaagatcgcaccactgcactccagcctgggggacagagcgagactctgtctcaaaaaaaaaaaaaaaaaaaaaagaggaacttgggaaagagcatgggctttggtgtcagcagaagcatgtgtccagttccatgctcttcccttatagctgtgtgaccctgctatctgcacagggacttgagcctctcagaatctgttactgcatctggaaaatggaaatctggaaatgtcactgcatctgtagcaayaaccaggccattttgttactaggtttaagtgagggaaggcatgtaaggcactcagtccagatcatggcacttagtaggcctgagcacatttgctcccacctcagtgacctccttgttaacacgacatctcctgactttggggctgcagagtgatgcagagcactggccagtgttgccatgcacccagggtgcagggagacctgtcttgcaggtgttcaaacaacttttgtcagcctcagtgtcagggacttttgttgcgtagagcagtcaccraatcctatggtgagaagagaaatcgttggagatgggggtgcaggggtggaagctcttatttcagaagacctgttgtgaggtaagactcagaccctcagcttctatccggccacagagtttgggaccagcctttcgatgtcttttggaagatgcacatggaatgcttagcctttgctcttccctggaacctggcttaggctttgcacctatcccaccatgtggttggggtgagtgaggacaacttcttttcctccagaacatggtttctccatctcagccctattgacattttgggctggataactcgctgttttgggaggctgtcctgtgtgccccgtaggatgtcctgcagcctccctggcctctgcctgctaggagccagtagcgccccctcccccacagacaaaaatgtctccagatattggcagatgtcccctaaagggcaaactacccttgctgtaggtaatacttgctttgaagtactggtgtggatggcctatgccctggcagtcttactaggtgggactggctgtcctctcattctcatgggawtggcctcatgctggtagctgacttcctccccgtgagaccgtaggtctaaactaacaaggtttacacatgtgacaaacatccaggttgccagggctcaaaagagggttcacatcgactcccttctcattcactgagtcctttttcrggagctttggccgagtttgtgctgcgtctgggcatctaggtgtcgagttcttccctagtgttttcagcctcggcttcctcctctgtaaaatgggagtaactgatacttttcctgtctgggtgggaaaggaaccccgtgctaatgtgattgatggtgtggtgctaagctctgctgcaagggatgtgaagttgagggaaaggtttaccatttattaggagctttgagaccaagttccttccacacaagagatatgccctgtcaaagggagatcccattgcaaagagattcactgccaarttccccctcccactagctccctggagcaattttcagcttttagagtgkttagaggcctcagggtgtaaagcgagagagagaatgccttccagccagcgagagagaatgccttccagccggtgacattgagaatagcaggaaagaggcagaagaagaaactgacttgaagggtgatgccagccaggggtgagtggagtgaggtaggatttgctttctgaaaactgggatgtgcacacaacctatcaagaatacttcactttgtgaggcccaaaaacagctcctagcacagtgtagagcagacttggtcagaacttcaatccttgayttttttttttttttaacccgaatttcatgaggtttttctgagacatccactggactgtcatataccgtgtgctgggctctcattttatccttacaattattatgttcattttaaagacctcatgttagctagatcagtagggtgactacagtttacagtaatctactgtatatttcaaaatagctagaagagaacaatttggttctagcataaagaaaagacaaatatttaaggtgatacatatcccaagtacattgatttgatctttacaaattgtgtgaatgtattaaattaccacatgtgctccaaaactgtgttcttgaaaaaattatcacgcccattttagagatgaggcacagagaggtggagggacttgcccagatccaggtatgtggctctcctgtaatckcgcttctattgctttgtgatcagcagcaacttagtagctttcaaagcttcaattttcttgtgtgccaaatggggctaataaataccttagaggattgtgatcaagattccgtgaaaaaatgtatgcagtgcccccggcaaggtgcctggcatacagaaagtgctctgtacgcaccagctgctgtcattattattgtttcaactaccagtgatcataaaggatgcctgctttgatgagcttttccaggaatatggactggtctgccctgatctacttgaataatctgtctcaggccctattcggtaaatacatgtaggaggtgcagctsccagggaagggagggatgttacctggagaggacagagtctgaagttcaggaaatacagcaagagccttcctcagggatgaaacatgtgatcttatggtctgactagcctcaagccagctgagctcattgccrtgcaacttggtagttaatgattgctagtaagaagtttaaaaggatcatcccctcaaagaatgtcagagttggaaaagaccttagggacattaggctaggaaagacaatgtcctagtgagtgactgcttgggccctgtatagaagggattctcagatcacttgggatgtcctggctcagcaggaggctaaggtgggatcaattagtgatgtctgccatggccacaagagaggcaaggagtggcacatgtgctgtttatttgctgtctttggctgcagctgaggacactgaggcccaagacttgcttgcttactggacgatcacccaagtcattaaaccacaaaaatctcttttggaaggaatctgttaagaatgtctgattataagagttgcacctttgagcaagtattttttgcttgatagtcttcagtgaggaggaactgtcttcaaagagcacattctgtcttttggcaattctcccaattagaacttagaccactgaggtagaaaggccttagaagcccctttaagtgggctcttctcaactggggctgcacctgagaagcttttggaaaataccagttggaggctccctccccagaccagtggattctggatatctgggtgtatggacacctcttgcccccattggtgttttattttccaagctcctcatgtgttgttaatatgtagccagggttgagaaccactgagaccaaaactctttggaaacagagacccagaaagggagaacatgattgtctatgggtatgtagggctagtggcacaaggagaaggaaaactaggggggaaaaggcctttatcaaatgccacccatatgctagtctcttttactttcatgccgagattcttctttttttttttgagtcagagtctcgctctgtcacccaggctggagtgcagtggtgcgatctcggctcactgcaacctccgccttctgggctcaagtgattctcttgcctcagcctcctgagtatctgggagtacaggcttgtgccaccacagctggctaaattttttgtatttttagtagagatggggtttcaccatgttggccaggctggtcttgccctcctcacctcagctgatctgcctgccttggcctcccaaagtgctggtatgcctggcccttttttttttttttttttgagatagggtcgtgttctgttgcccaggctggagtgcagtggtgtgatcacagctcattgcagcctcaacttcctgggctcaagcgatcctcctaccttacctgcctgagtagctgggactacagatgtgtgccacctctcctgggtaattttaaaattttttttttgtagagatgggggtctcactatgttgccacagctggcctccaagtcctgggctcaarcgatcctcccgtcttggcctcccaaagtgctaagattataggtgcaagccacctctcctggcttgcttctttcccgtaaattgaggtgtgttattccactgcttaaaagcctacatggcttcatatcgctsttagtataaacccaaacagtggtctgcaagactctgaaccttagatyaggatgatcagacccctccctcccctccaccctccgacctcatcctggctacccactccctgttcacagactrcagtcacctggctctagtacaacagacacttgaacctaccccgcccctctccctcagggcctggtactatcctcctcgctccttcttatcactcaggcccctctatcccatcatcctccttcatttcctcccatccttatcacctactcatttctgtctgtctccccacctcttggattatgagttcaggggagtgggaccccctatgtctgatttccttatgtgtaggacagagcgtgcctcaaaagcatgcttgcttggtgaatgaattgaaagaaccaccctgacatggagctggtattatccacaggttacaatggactggacctcctcttccagtcccatataatttttttttttttttttttttttwaattttgagacagagtctcactctgtcgcccaggctcgagtacagtggtgatcttggtttactgcaacctctgcctcccaggttcaagcaattctcggtcctcagcctccccagtagttgggactacaggcatgtgccattacacctagctagtttttgtgttttcgtagaaacaaggtttcaccatgtttgccaggctggtcttgaactcctggacttaagtgatctgcctgccttggcatcccaaagtggtgagattacaggcatgagccattgtacctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctcttactaagctgtgtgatcttgggacattactaacctctgtgaggttcagtttttcttggctgcaaaatgtaagcacaatactaataagtaactgacagatgctgtgcttctgccagacactgtacccagtgctttgtgtgtattggctgagtgaatcctcatgacaccctaatgaggtaggtctcttctcttcttgctttcattttacaggagaggaaaatgagatgcagagaagctaagcaaccagcctgaggccacacagccaatcagttgagagtcagagttcaagcctaggctgcttgctgccagagtcagagtgttaggtaggactttatgaaatcatgcccacaggccccggaacaggtagtggtgcagacacttggtaaaccgtagttacccctcccactttgacatttactctcctggtgacatttaagttttctgactgttttgttgttcaagttggtgacaaaagtaccaatttcctgcctgctcacttccaaacacagcttctgttgatgagaactaagggagtacaacttttcaggccgggggtgtgcatggtgttttgggccttggtgctcaggaagtgtgggcactcccttaaattttttaaatgggcaaatgagtgcattttcctatttaaatttttttttttttttttttgagacagagtctcgctctgtcacccaggctggagtgcggtggcgccatctcagctcactgcaacctctgcttcccgggttcaagtgattcttgtgcctcagcctcccgagtagctgggattacaggaggctgccgccacacctggctagtttttgtgtttttagtagagatggggtttcaccatgttggccaggatggtctggaactcctgacctcaactgatctgcccacctcggcctcccaaaatgctgggattacaggcatgagccaccatgcctagcctcactcccttaaatttttaaaatgggtaaatgagtgcattttcccatttgaaacattttctgcttcaaatccttattgagcactttgtgctaggcattgtgactatgatcagtataaaaaccccaagaaaacaaaaaaacaaaaacagtaattcactgtcctgtcacccccaactcatcaatcctttgcttttccataactggttacctgggtgcttttcttcgttgtgattattttttattggaaatgcagatttgtgactgtgatgggcctgaggtcaggtcaccttgctgaggcgagtttcctgggcggctttgccctgttttgataaacagaagaatgagcagctggagctgcatttcaagtggctgctttagttgaggcaggcaggcctcagtgtttatgtgacaccgagcagcttcaaaatgagcttggtcatttaaaaaaatttattttttcctagttaggtaacagtggtataacaacattaaaagaaatgtagaaactagagaaaggaaaaaaaaaagccctttatcccccccatcacaaaactattataatttcaaaatagttacaagtacaatgtattccaagtggcttcttatttaagataattatattcacagagcagggaccgtttcaggtcctttaatgctgaaaggctaaataaagagaactttttattttttccatgttaatacatggatgatattaaccatgatgtttaatagctacagaatactgcatgaaatggakgtactataattcatttagcctttttcgtatttagagatttaagcagtagccaatttttcaccattacaagtggtgcaaggaccaatatcttcatgaatacagcattttctgtaaagcagaaattctttcttcaggattaatttccagatatctttytggtattagacacataccacttgcctaataacgttccaaaaggaattcattgtttacattgctattagaacataygagattgcctgtttcattaygtccgtcccagcactgggtattatcattaaaaaaaaaagattttaaatttatttattgagttatttacttgagacagagttttgcttgtctcccaggctggagtgctgtggcacgatcttggttcactgcaacgtccgcctcccaggttcaagcgattctcctgcctcagccttccaaatagctgggattataggcacccaccaccatgcccagctaatttttgtatttgtagtaaagatggggtttcatcatgatggccaggctggtctcgaactcctgaccacagatgatccacccaccttggctcctcaaagtgttgggattacaggcgtgagccaccgtgcccagccaatattttaaatttaatgtttacatttgcacacatgccaattgggcwtcatggtggctgcctcacaccactttttgtccgtgtgtgagactcacatakaggctgttttctgtgatccttttttaaaaaataattacatttttttaatgctcagggaaaatgtcaaataattgtttatgttttgtactgaaatctgcactggtctgatggtacccagaaaaactcttaactgtagccagaaaccagctgagcctagttgtatgcaacctgactgcaaaggtcatcaggtgctctcattttatttttagagctatattttagctctaacgtgattgttgggtgaacacttgcagaatgaaatatgactgacacctaccagctgtctayacattcctggttatatcttaggaaggcagtgtgtgctagcaccttgggaagagaatgttgagttcaaatcctagttttgccccttgcaccaataccttgatcagattcctcccctgcgtcctccctaccctttcttcaacttcacaccttagtttctttacttgtaaattgggttgatagtgggctgctgtcagaattaaggacatcgttttgtcaaggattttgcatacrggaagtcatggtgacagctgttgttactgttgtcctgaggagtggggacaggagaggaggaaaacaggctggtccaggtgtctttccttaaaggaggctccagcttagttggggagatagatgggctggtcagagtttcaagtcataggcagtgcaggcctcaaaggaacagccaggacttgagacaagaatcaggccaagtgagtaactgttgctgctgtggcagtgaatgttagcagcccaggcctgcaggggggaagactcatttggggtacagtgagaggtcttgctgggcaaatgcagggtgtttgcggcaaggtaggctggggctggacttggaggatgcctgcgtgatttagattctatcttgtagagaatgaggtatcatggaaggattttcttttcatgttgtaaatattaatcattttattgttttgtatttttgatggcaatataaaaataccagctttgttgagatataatttacatacagtaaaattcatccatttagaaagtatacagttcaaagctgggcgcagtggctcatgcctgtaatctcagcactttgggaggctgaggtgggtggatcacttgaggtcaggagttcaagatcagcatggccaacatgatgaaaccccgtctctactaaaaatacaaaaattagccaggcatggtggtgggtgcctctaatcccacctgcttgcgaggctgaggctggagaatcacttgaacctgggaggtggaggttgcagtgagcagagatcatgccactgcactccagcctggacgacagagtgagactctatcttaaaaaaaaaaaaagcatacagttcagttgtttttagtatattcagaattgtgcaaccatcactgctgtctagttccagaatattttcgttactcacaaaagaaaccccatgcccacgagtgctcactcctgatttctccctcccccacctcctggcaaccaccaatttgctttctgtttctgtgaatttacctgttctatgtatttcatgtgagtagaatcatacactgtgtgtccttttgattctggctatttcgcctagcatagtgttttcaaggtccatccatgttggagcaggtatcactgctttgttctttttttatggctgaatgatatttcatcacagagagataccatgttttgtttatccttttatgagctgatggtcgtttgggtcatttctactttttggctattgtgagtgacactgctatgaacgtttgtctaccagtgtttgtgtggccacgggttttcaatgtgggaggattttgaactggggagtggtgtttggagcctttgggtggggtgggctgtgaggagcctgtgtgtgtgtctgcccttactgggctgggtttagggcaagcttcaygtgcttcctttcttttaagggactctctgagacagggttattatcccctttttgcagatgagggcactcaggctcagtgaggttaaataagctgcatggctagacaatggcagatagcagccctgtccggctcttagccagcttgcagccacctgcccctgctgggccaggcgattgcagtggtcttggctgggaggggcccagaggctgtgtggtgctggagagaggcagcaggctggacctggttgggcaaggctgagtggttgtgggataagaggagatgtttcagagcagcacccacagaaccgctgtgatgggagaaacaagacttcgagttaggagagtgggttggactcttggtgcagcctatgtgaccttgggctgatcttgtctcttttgagcatcactttcctcatctggaacctggggctcttgtggcttcctgcctctctcaagggtgattcgggaggaagagtgggagagagagagagagagggagaggatggaggcgagagaggtggagtgggaaaggagggcagaatctgctagaacctgcagagctcataatctaggggcggggagggacatgcagcaggtgcaggcaggtgtgggaggaagtagcctggtcatctggatggacatccctgcccattcagagaagctctgaaccctgcaaaagctcccacgtggaggccagtgagctggttataatccagagactgtcagtttttcctagtacatatttgracytgagcctttgtttctgcaaagagtctggtactgactcacacagtgtcagcagcccccttccatcccctggcacacccctccctcattcctactgagcattaccttaaaaccagtgaggtctttctgggtcttaaaggtcacccagtgtccttgcctatctgggcctgtctctgttcaagtggcaaggcggaccatcccctttatcactgacttgcagcttgcctgggttttgtaaaaagcttgtcattgccagttagaaaataaagacagaaacctcccctttggcattggtatcgtgatgacttgctcttgttctgactctattttgctggcttgttatgagtcagtcatttttttttaatgaaatgaatacctttgtcttaatatgaagctaggcatatatgataaaggtyagatgatttttcaaatatgaaatcagaattctacccatactcccaaattagagagcagtctgatgtgttcccctttactgtgaccagtggcttcataggggacctagttatgagtcctgtttcttttttttttctttttttattttgagactgagtctcgctttrtctcccaggctggagtgcagtggcgcaatctckgctcactgcaagctccgcctcccgggttcacgccattctcctgcctcagcctcccgagtagctgggactacaggtgcctgccaccacgccyggctaattttttgtattttttttttttttagtagagatgggttttcaccatgttagccaggttggtctcgatctcctgacgtcgtgatccgcccacctcggcctcccaaagtgctgggattacaggcatgagccaccacacggggccaggcctttttcttttcttttttttttcctcactgtgtcacccagactgtagtgcagtggcacaatcttggtgcaacctccgtctcccaggttcaagcgattcttgtgcctcagcctcctgagtagctgggattacaagcatgtgccaccacacctggctaatttttctatttttagcagagatggggttttgccatgctggccagggtgatcttgaactccagacctcaagtgatctgcccgcctcccagaatgctgggattacaggtgtgagccactgcacccggctgaggcctttttcttctgtgcgttcctgctgtcttccctccaggcagcagcaagctggtaggagctgtacttgtgagttgacatcatgatgtacagtcactggtcacttataaaactgggcaggcccagagcaggaagggtcattgagggtcatctaatgcaaaccgtttactttagagatgttgaaaccaaggcgcagagaggggaagtgacttgcccaagaccacacagctaatatcactgtgagcccaggttcctggctccagttcctggttctttctgcccccttcttcccgacactaaagatacagtggtgagcacacagggtattcagtaacgtatctatttttgacctgtttttaatggaggctgaattgggcttttagggttgagttctgacacgtgccaggtgatctgctggagggaaatctgttacttctggggaagagttgaaggtgtcttctgaactctggaatctgttttgaggggaggctgagcccatgcgtggacccttaggctgagcccatgcctgcttcagatgttccacacctttcaccacaatttatttatttatttattttttgrracggagtctcgctctgtggcccaggctggagtgcagtggcgtgatcttggctcactgcaacctccgcctcctgggtttaagcaattctctgcctcatcctcccgagtagcagggattacaggcatgtgccaccacgcccagctaatttttgtatttttagtagagacggggtttcaccatcttggccaggctggtcttgaacttctgacctcgtgatccaactgcctcggcctcccaaagtgctgggattacaggcgtgagccaccatgcctggcctatttatttattttttatttttttgagttgaagttttgctcttgttgcccaggctggagtgcaatggtgtggtcttggctcactgcaacctccgcctcccaggttcaagcgattctcctgcctcagtctcccaagtagctgagattacaggcatgcgccaccacgcccggctaatttttgtatttttcatagaggtggggtttcaccatgttggccaggctgatctagaactcctgatctcaggtgatccacccacctcagcttcccaaagtgctaggattacagtcgtgagccaccatgcctggccacaccccggtttattgcatttgcttctaatagagaaatcaacccagtaaacaaatgaattattgttagcaaaactggggggtgggttgggaaaggaaagtagttccttctataataaaacttgctgatatttcgttgaaagtcattgtcttactcatccttgtataagataagtcacacaatgagtggtatcagggttgcagggtttccccctgtgaggacacratgggatgaaccgtgtgtgggatggtctgttaaagaaaaacaagaagccatgtgttggaaacaacctaagtattgagcggtggaggattgctgaaattgtggactactatgcagtcattaccaacgcactgaaaaaatgttccatgatatggcaggatgtttatgctataagaaatttaaagacgcgagcttcaaagtaaagtataaacctaatttggtcaaacaggctgggcgcagtggctcacgactgtaatcctagcactttgggaggccgaggcaggtgggtcgttggaggtcaggagttcgagaccatcctggccagtatggcgagaccccatctctactaaaaatacaaaaactagctgggtatggtggctcatgcctgtaatcccagctactcaggggtctgaggcagaaggatcacttgaacctgggaggcggagggtgtagcgagccgagattgtgccactgcactccagcctgggcaatagagcgagactctgtctcaaaaaaaaaatattggttaaagaaacaaacgttagacttgaagccgtgctttatatggatatgtggtgcactataatgtggtgcttaaaaagcaacttaggcagacctgggccaagtctgggctctgccacgtaactgctatgtgcccctgggcaagtcactggatctttcccagttcaggcttctcagctgttaagtgggactagtaccttatctctttgggttgttgtgagaattaaatgagctatctgggctttcagagaaagggcttcatgtgccgtggctctgatcagaccaaacaagttatctactgctctaagccatcaaggccccccatgcctgttggatactgttgagttatttgggttggcatgtagtgcagcgtttctggacatacatactctggggactccccatcccaaatttcttacagtctctccagtgtgccacacgctttcttgccactaggtccttgcatgtgatggagtaactcttgtacctctgtctccctaaatagacggggttctccaaggacatygtgccacagggcctggtaacccagtaggtgctcagtaatttatttatttatttattttttttgagacagagtctagctctgtcgcccaggctggagtagagtggcgttatcacggctcactgcaacctcccactcccagcttcaagcagtcctcctgcctcagcctcctgagtagctgggattacaggcgggtgccaccacgcccggcttattttttatatttttagtagagatagggtttcgccatgttggccaggctggtctcaaactcctgacctcaagtgatccgcccgtctcagcctcccaaagtgctgggattacagggtgaaccactgcgcggcccattaggtgctcagtaatttgttgaatgaattgaagacatgggacttgarttaggcttttattattattattattttttgagacggagtctcactctgtcacccagtctgggagtgcagtggcgtgatcttggcgcactgcaacctccgcctcctgggttcaagtgattctcctgtcttagcttcttgagtagctgggattacaggcatgccaccacgcccaggtaatttttgtatttttagtagagatgaggtttcatcatgttggccaggctggtctcgaactcctgacctcaggtgatccacctgccttggcctcctaaagtgctggaaatataggtgtgagccaccatgcctggcctattattattattattattattattttggagatagggtttttctgtgtggctcaggctggacttgaattcctgagcccaagtcatccttccgcttcagccaattgagtagctgggattacaggtgcactgtccstcccagcaagttgggtctttaaataaagagtggggtttggtgagcagggtgggtgcactgttctaggaggtgggcaggacagaggtcagtggtggtccctactgcctattcagggaccagggcccctgggcaaaggcagagataacattggcacaatctgcctttcagctttcattgtcatgcgggagtcaccatgctttgtaagacatttaatctataagacttgattagttttgctacctttcatagcttggggctgtgtatgcctgtttgtaagagagatccatccagatcaagcctgtgcagcaataatgtatgtgcacaaggcctcttgtgttgtgctgatggtaagataggagctggacttggaggcaggaggtggcctgggttctgtttctggacttaccacttactagacgggtactcttgagtggagtcacttaagaaagtaatgccgatcaggggctcagagtgtcccaagtgttttctcttgccttattctcattaaacagaagtacagctcagaatatgatgggccagtcttatgtgattggtgttaataaggcagtagagagttgggggtactctggcagaccatgagaacctgccctgtttgaaggagaatgctgcctcctcttcctccttttaaaattcacacatatgatgctcactaagtgtctggcacccttttttctttttctttttggggcagagtcttgctctgttgcccaggctggagtgcagtagcacaaacacacctcacttactgcagcctcaaactccctggctttaagtgatcctcccacctcagccttccaagtatctgggaccacaggcacatgtcaccacacctggctaattaaaaacatttttttgtagaaatgaggtcttaccaggtcgcccaggctgatcgtgaactcctgggctcaggtgatcctcctgtcttggcctcccaaagtgctgacattataggtgtgagccactgtgccccgcctcagtttttaaaaatacttgcttaaggagagagcactgaaggaagatttagatctgctctgttgaagtgacagagtacggtggtttccatttatgcgtattttgtagttcggatggcttcttgtggggagtcctgtgagttcacacttgggggcatggtgtgggggacctgtgaagtgggtgttctggggtgagtgcgatgctagtcactgtcccagttttcttctcatttctttttttgtgagtgcttggctagtggcagccttgcagatcagctagttttgacccacatcctccctctaagtggtgctcattgaattgagccacagccccaaggtcatgttttcaaggttggcatttgggaggccttgtcagaaggtcttataccatattccagtcacccaragtgctgcccgccatgcctgttcgttcagcaggatttccctgagcacctgctctgtgccaagccctatgctaagcaccaagggagtaaatatggagggcagtgtccccagagtccaggaactcgtgatctagtcggggaggagaggggtacctactctgtcttttacacagcaagtgtaacctctgaagaatgatgttccaggaggcaagagcaaccctggcggactggtggagctgggaagggaaagatgcttctggaggggccttgggagaagagtcctccagggtgagccccttgagagaggtttcagagctctcatccatcttcatatcctggcacttagcccaggcactaaaatttgcatatttttgatggcaattaaaaaaatactagctttactgagatataattcacatacagtaaaattcacccatttaaaaagtatacagttcaaggttaggcacggtagctcatgcctgtaatcccagcactttgggaggctgaggcaggtggatcacctgaggtcaggagcttgagaccaacctggccaacatcgtgaaaccccatctctactaaaaatacaaaaattaaccgggtgtggtggtgtgtgcctgtaatcgtagctacttgggaggtggagacaggagaatttcttgaaccgggtgggggaagttgcagtgggctgagattgtgccactgcactccagcctggrcaacagagtgagactctgtgtcaaaaaaaaaaaaaaaaaaaggttccattcaagatgtcaagccccacgggactgagggtaacatgagggtaacagacaggtgatgttaaattccatttgggctcatgttcacccccaggccccttattttctttcaaacacatggaatgggcatttagaactaggaagatcatgaatctggtggctgtgtagatgccataccaggtatggaccacaggcttggagcgcagcagcatacaggggtcagaggtcaaggccagtggtctatcagaacccagttcctgcaggagccagtgccggtactaggtagactcagatgactgaatggtcctcgggatctgarggccagtgggggagatgaggcctggcctcccggaagtgctcagtaaacatttgttaatcatttcctgcctagggaagctctgtggtatgctcaggagaatcttgcttctcrtgggggaatgggtggttgtcatttgggtggcctgactgccagcctgcttgctggctctctgggagttggggtggtggcatcaacctgcagaggcggggcagtggggcagctcacggctgtgtgggtaagtaagcagtgagcacagtgagggagctgttgccaggagcctcttggcttagtgagccaagcagaaccatgtgatgcaccctgtgggcggccacctggggactcaggacatgcacccagatccctcctcccctacccacttcaaagaaagtgctgccctcccagtggtgatgaagaccttccgctggccccagcctctgggatctggcctttacttgggtattcatgtggccctgggrgttggctttgctgaagttgggcagagcaggtgggttctggaatgtgcaggggcaaccagagtgtccatctgtttgggtgaagccagctgtttaggtctgaaggatctgtttgatttttagaaacatgatgtgttccagagttagtaggtggtggtgatggagggtattggcgtgaagagtgtggatgctcttcgttcctttgctgttttgggactatctctctatggggtagtggcccctttccttgttaggatcatttagaaccccctgggatcatgagaatgaatgtgggtctatccttccttctgtgtgaggaaaaggggaggtattgtggttaagcaagtttggagaactctggcctgaacaaaatcaaacagatgtctttcttgcaggacttagaagaaacttaaatctgttggtaactctttaagagggaaggggatataaaacccttgttttccctagatttttgttttactctatagctgtctctttttagaagcatctcatgagactaatgtttttaggaacctgctgtaggaaattcatttattcaaaaaatatttgttgagcatctgttatgtgctagtgactgctccaggtgcttgggatacagcagtgaccacctccaaccaagatcccgctttcaagaacttccattctagcagaagtgatgaactcatttttatggagcacctactgtgtattaggcatgtgagttatcacacattatctgctttacccctcacaacagcctggtgaggtagatggactattttattttattttattttatgacagtgtttcactcttgttacccaggctggagtacagtggcgcaatctcggctcactgcaacctccagcctccaccaggttcaagcgattctcctgcctcagcctctcgagtagctgggattacaggcatgcgccaccatgcccggctaatttttttgtagtttttagtacaaatggggtttcaccatgttggctaggctggtctcgagctcctgacctcaggtgatctgcctkccttggcctcccaaagtggtgggattacaggtgtgagccactgtcccaggccagatggaccattttaaagattaggtaactgagctctaggggtcaagagacttggccactttggcagctgcattgtcgtttttggattatgtcatcaaattgcaaggggaggtggtgaaataaggaatttctgcaacagaaattggagtctgcggtggggatgctgcaggccttagctgctgtatcactgtgtccgtttatgaaggcccgatggagaagaggctctgaatcaggccgggaaagaggtatttctctggaacaactggtttgtttctgtgttatgggcaccgagaagcgtgtggctcatcatgttttcctttggctttggttactaagcacctgagagctagatttgtggcccatcttgacacttctgcaggatgggaccatatggcatgcatttctatgtgctgatcttaccccaacctcccgccctccatcccgctttattattttctctatactcatttttgccttgcctggttctcttgtttgttttattcttttgtgttatttgtattattctaaaccaccacatatacttggtgggatggagctgggtatagttaaattttaaaaataatggtgagggccaggtgtggtggtttatgcctgtaatcccagcactttgggaggctgaggcaggtggatcacttgaggtcaggagttcaagaccagtgtggccagcatggtgaaattagccgagtatggtagcgtgcacctgtaatcccagctactcgggaggctgaggcaggagaatcccttgaacctggtggaggtcggaggttgcagtgagccaagatcatgccactgcactccagcctgggcaacagagtgagactctgtctcaaaaaaaaaaaaaaaaaaaaaagaaataatactaatgatgagatgacttgcataagatcccccagctactctgtggggaagtcgggctccaagccagctctcctggccccaccctctttccaacatactcagtgcctttctggattaggatccactgcaaggttcctttgcagtgggagccaggtctgtttggcttttgcagccattgtgttatgggttccagtggaagctgggctggctggattggaggtgttgaggggcttggattgacctaagtgtcacctgtggctcaagcaaggctctggactgtggattccttcttggtgagggctgttcagcctcacccaggagagaacccatacctctgcttcttgcttgtgaggcatcaggtttcaagcaggggtcagaccagatgagcactgttatgttcttcacagctgcttcccactcgttatcctcatagtagcccagggtagaaaaggagaggatgagtgggtggtattgatgaagaaacggagacctacagaggtgaaatgacttcacccaccaggtgatggctgagtctgcaacccaacaaaaaactctggcttgctggcatttctcaggccagacagttccaatgtgaacccacggtaccttctgcgggagaaaaggtggcatgggaagcaggaagagcctaggatttgggagttggatgccatggacttgagtcctggccactactatgtgcatatggggaagtcacttttctgagcctcagccgcctcatctttaaaatgtgggccctaatttctgccctgccagcctcacaggatggtcatgagaaactgaatgagaagatgaacatggaagccttttgtctggcattaaccacatgtgcctgtgtgctgggttctgtctgcattgtgctaatgatggtggtgatggtattaatagtaataatagtgaacatttaaggaacactgcctcctataatagtcaccatggtaaactttacatacattatcttaatgaatgcagaaaacaagcagatgagcagggaccgtctattattttcccatttatttttgtttatttttaattttttttttgtagagacagggtctcatgttgtggcccaggtcttgagctcctgggctcaagcaatcctcccacctcggttccccaaagtgccaggatcacaggtgtgagttacctcacctggctgtattttcccatttttacaagtggaaacagggggttcaaaaaagtttatgtaatttgcttaaggttgtagagatgttacatagtggagtccagatttgatcccaagtaggtgaccctactgtggtatcactgctatcagattggaaacagcagaagtctaggacctttttggtttggttgatgacatctgtgcacatcattctggtaggtaggggccatctgggggcaggaagttgggtgtgggtaggggttggccctggagaggcaatagaagctggggcttggctggataacaagcctggcacactgagtttgtctctgaggtttagtttctcacctgtaagatgatgatataataatgtgcctcatgggattaaagaaaataagagatgcctagatacttatacattgctataaaaatgtctgtgttataagagtgacatggcattccacaaaatgcagtgtagatgtaaattagttggaatggtgacctcacccctgctaggtagcactggcttatgtcccacctgagagtagtagcatctgagggctagccacactgaacaagccacacacctgacctcagcatcctcttctgtgaggggaatgctctctgctcytctacctgcatgcaccgtgtttgtggaagtgctctgtgtaggacagggaaagcaccttgcagagagcaagggcccactggctgcagagagcctggtgggtgatggaccagagataagggtgagggacagtttagagtgtcacagtttctcatagagctttgggcagtgacaccagtattagtctcaggaccatcattgactcctggttagtttttctgttttcaaaacactttatcagctgtaaagcacttaaaaatgtaaattagttcctgcaaaaacaaaatgcacaaaaaatgatggctctgccaggctgggttgggagatgaatgtgtatgcatgtgtgaatggattcatttctgatgataaaaatactttatgcttatttatgtgaaacttggaaaayagaggaaaagtataaaattgaaactaaaagtcatccataatccttytaagtagctttatcatttaatgttttagtatatttccttcctgtttttttttttttccttaattctgggtgtatgcaaaggattttgtaaccctttacattctggaaactgttcaacatgacttcttttttttttctttcaaccaatttgtggagagtccattttgcaaagccttagcacrgtgccaagcacaagctacacacccgggatgctgctgaatgcagatgagagcatgccarctctgctgaagttgggggctgggggcagtggatggctgtgagtggtgtgaagcyccgggccacagtgaagaccctggaatggctgagagactgggattccaggagaccgaggtttgaggggaggcttttcattgtttgattagctctttttttcttaccacatgtaagtcatcataatacttaaaaaattgctgtaaaaagcagctaattaaaaatataaatacagtctttttggagactagaaacagtcacaagagaagcagtttcagtgagaaccagatcctttgtcagtgtcagcgagggggaggggcgtcggggcccagccagcaaatccttccctccgaactgggggtgcggaatgtggcactccctttagttagacttgatgagctttggatttgagtaagtgacagccccttttatttcctgctttgttctctcccaggtaccagttgaccacagttttcattcatgcaaatggaagctgacagctgcccagggagggttagatacctgggaggatagagcagaggccctccttctccccgacccctcgcctctgcaggctggtggggaggggggcaggggagtcsagttaccctctctccacgctttcttcttgtgtatgtgtgcgtgtacgtgcgtgtgtgtgttgtgtgtgtgtgtcttgggggatggagaacccctctcaggagggcctgtggaaaggctggggtaagtggagtgagcccgtgggtcctgcccttccaggctgccaagagtttaagttgctgcctcccggtctctgtgcccttttcctgcctgtggaaggccctctctctgtttargaacgtggatgtggcaggggctgggcgggcacttggcctttataacaacagaagaggattttcagtgacgaggaagcatcccgcccttctggttccctgtcttccacctggccccactgcgacagcctctccaggcctctgacttcactagaatctgcccctccaccccaccttcccccgaaccccacctcctttctctgagcctgagaggagttaattgtgttagagtgcactgagaaacctccaggaaggggccctagtccctgtgttgcctgttcagcaatcacatttgctcacgtctagaaagtacaatataatgactcaggttaaggggtgaaaaaatgtggtggacattttgccagggtactgtgttaactgttccaaggtatcaccctgtgtgagactcaggaacattcagtgttttggtttcccccctattgtactgaatgccggcagctttccccttctaattatttatcttaataatttgaggaaagttgatttgctttttaaaaactggcatccaagcgtaccctatcgcactgcacacagctgagagattaaggcagttctttagaattcctagtccgtgttgtgtacacagcgataggctggggtagtggttctgggtgcaactggggacaggcgaggaaccataaatttggcaggaaagatttgtgttggtaccctgttatatttgctttgcatcacatattgtttaaaaagagcgatattttcgttaaaggaaaaggaactgtgtatttgagataagaagtagaataaaatgaaatgaatagttgggtttcgtcctgtggccttcaaaatggcgttatttctgagatccctgtttctatgctgttccagtatttatacggaacttataaaatacaaagtataggcatgtcccgagatcctggcgaggctgtaatttatagtgttgttctttttcttttgttttacagagctgagtttggtgaaacttcaggaggttttagctagtggcgatccaaagacattaaatattgctttgtgggtacgwctccaccttgygtcttacttggtgactgttcagtggtaggcaaatgtcagaacccagtatgcaaatgtggaagtggacagatttgagtcagttatctcagctggtgttatgaaatacrgaaatttttggcgttggtggtggagggcgttggcataggaggcgtgaatgctctttgtttcttgctgttatgggagtatctcttgattgccccatcatcttgtttggtgtggccccgtttccttctagaagttgagttccctgggcttgtgagaacccttgtacatctgcctccattaaactcacatttggagatctcgtaaatgaacscagtgcagtccgggggcagagtgaaggctcagactgcagccggacatggctcagttaccctaggtgggttagcagctgagcaggtactggtctcaaaaccctctgaagcgaagctgcctgtcgattccacagttgccagcttccagcatggagcttctggaagtatcacggactgagttgggtcccaatgctggatgtccctactcttcctcctgcccctcccacgtttggatgggcaaatgcactaagaacagcccgtgggcaagtgaatgaaaccaaaaagcagcaagggatttggacagtccacctcagagtatctgactttattttgaggggcatgtgtcagagttgggtgaagaaagagattctcagatggagatagagaaagatccccaaaagggcaggctggctaccagtgatttatttttatttttcttacttttttaagagaatgcagggcattttactcttctgtggtaggagagtagactggccacagcccagcccagaacccttaacaaaaggttaagctgctgggcatggtggctcacgcctgtaatctcagcactttgggaggcagagatgggtggatcacctgaggtcaggagtttgagaccagcctgtccaacatggtgaaaccctgtctctactaaaaatacaaaaattagccgggcgtgttggcatgtgcctgtaatcccagctactggggaggctgaggcaggagaatcgcttgaacccaggaggcggwggttgcagtgagccaagatcacgccattgcactccagcctgggcggcaagagcaagactccgtccctwaaataaataaataaataaataaataaataaataawtaaataaataaaataaaataaataaaaaaagaggttaaggtttatacgcaggccatttctaatagatgttatggaagccccaggktttggggcatcagggttggaaaggaagccaaaaatgggtgtgtccaaaggacagatgcattgagaatgggttgtaaaatttcagccattgtgtagattaaccagcacggcaccctgcccctcagccattgtgtagattaaggagcactgcaccctgcccctcctcccccaagcatgcagcacctgagaaagaaatctgacaaagatgctttaatatgagtctagcgctttgagcctttcattgtcatctccagtgcaattgtctgtgggttttgttttgttttgttttgttttttcatttttattggactttgctttgccttttaagggaaactctggatgatatacttcattatttcacttgtcagatggttagtaatatggtattgccattcctgacctaaggcagcaagtgattccttctggcaaactctttaagaaacatgggcatggagcctggctgcctgagttcaaacccctgctctgctgcttaccagttgggtgaccttggtcaagttacttaatctccgtgcctcaatttcctactctgtaaaatggagataataatagaacctgtgtcattacattattgtgggaattaaatgtgttagtctacgaagaggggtgcctcaggcccatggtaaattttatgtaagtgttggttgtatataagatgatgaagtccgggcgcggtggctcatgcctgtaaatcctagcactttgggaggccgaggcaggcagatcacctgaggtcaggagttcgagaccagcctggccaacatggagaaaccccgtctctactaaaaatacaaaattagccaggcctggtggtgcatgcctgtaatcccagttactcaggaggctgaggcaggagaatcgcttgaacctgggaggcagaggttgcagcgagccgagatcgtgccattgcattccagcctgagtaacacgagcaaaactccatctcaagaaaaaaaaaaaaaattaagatgatgaagatgcagcgtggggccatgagaagagtcctggtctggtgagtttggaaacctggcttctggcctgtttctaacactgtatgtccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaagatgcaggaggaagtaggtgagctgaggggaagctggtggggataggcctggtggggcctggggagaaggatttgaaggctcaagtcacacggtgcaggatgggactcaatatagggtgggatagggcggtgggtaaaagccgttacaattttgtccaaatggtatgggctgatttacttattagggaggtacaaatggcttcrtgttataaagtgtcaagatccttatttggataaggcaaccagagtgtagacgagagagtaagagtaagaaaacaaggagaaaaatgagtgtcttaaggatgtagaaatttagtttgctggaagtctctgcagcctgaacaaaacagctgttaggtttgccagaacttaaaccagagggtgcctgccagtggttcatattcttgctacctcttcctcctcttgtcttgtttttcctttccattctaataatcacgatgagtttccctgacatgcacgccccttcattcatttgtatgatcacttagagatgaggagctgccttgccaggtagaaaaaccattctcaggatgaatctttggctttctgaatcagagttttctttgggttttagaacttcattcttattaaagtgggaatttaccggccgggtgcggtggctcatgcctgtaatcccagcactttgggaggccaaggcaggccaatcgtgaggtcaggagttcgagaccaccctagccaatatggtgaaaccccgtctctactaaaaatacaaaaattagctgggtgtggtggtgcgcgcctgtagtcccagctacttgtgaggctgaggtaggagaatcacttgaacctggaaggcaaagattgcagtgagccgagatcacaccattgtactccagcctaggcgacagagtgagactcggactcaaaaataaataaataaataaataaataaataaattggaatttaatatctcttatcatttcttcaattccagtttttattagatccacaacttttttggtcaaaaccagaattttgattatgtgtgccatcctaggctacctcaccatccaaaaatcctcttggaaaaccccacgcttatcaggaaaaggagatggaagtgaaaaaataaaaatatatataaaaaaaggaaaacctagtgttagcaccccttatscagcaggccccccacctggacccccacctgtattcacattcctcccacacttacagtcagtggcttcattaatctctaaggttccatgttctgctccccaaatagactgtttgctcattgaagacaggcaccacacttacattttttttctttctttctttttgttttgagatggagtctcactctgacgaccaggctggagtgcaatggcgtgatctttgcttatttcaacctccgcctcctgtgttcaaggaattctcctgtctcagcctcccgagtagctgggactacagacgcatgccaccacagccggctaatttttgtatttttactacaggcagggtttcaccatattggtcgggctggtctcraactcctgacctcaagtgatccacctgccttgcccttccaaagtgcwgggattacaggcgtgagccactgtgcctggtcttatatttcttttctatttttctaccctgatcaaccttttcttttctatctctctcactgtttctacgatcaaagtagtggagtcagtttccttgcatctgtcccaagcagccgttgctaatgggaatgagtgtcaggcactgtacatcagccctgttttgaaactctgtgcctgctgcctcattgactagctggagagtgttgaacatttggttgtagaatgtatgtggattgctgagtttcacgcatgagctgtgttgtcatttcattcattctgagtggcatctgcgccagggctacctggagtttttccagctccccaggcctagcaaaggcagggatcctgtctcattcagctgyatttcttgagctgtgcttagaaggcctgccacacagtagggaatcaggaacagtcgcgtttacagagctctcgggtgatagaagggaaagtaaaggtatattaaatttcttctaggcttgctgcctaatcccctaaggggccttctcatttctttcagcagtgccatctggcaggcctgagagtatatgggaataagtggggtgctggatcttgtgggcaggctatgggatctgggaaaggggttagcacctgggcctggagggacctggaatctaggggggscatacatctaagctaaatgtggctgtggcttgcaaactcagaggcctttcgggcagcctggtgaaatgataaatgggcagttgctgtttattctcagtcctagagattaaaaagaggtgcccccattggaaactggaggttacatgttctacccaaagggagcagctgccagtcggcttcttgcgatgtgaaagtacagccccagaaaacccaggttaagtgatgtcccctaatttttaaaagttggcaaccaattcaactataaaatcatgcctgctggcctctgagcagtaggcagggctggtgtatgccggaggccaccaggggacataacacctgccatagggtcagaayaggtgggtgttagtcaccatccagatggtcagataccggaattgccacagaaatgaacatgacatgcagagcaggcagagcaggtgccaaaagttggtatcaaggaggcgaaggtcaagttctttgcccaccagaaagccttctgttccttgtctccttcccttcctgcacctccaaggactctccactgctccctacagcttaagtccaaatttccctgtctggcattcaaggtcttccataccttccttacaagtgccctttaggcgctctaaatggcgcgtcagctcctatgtgtggcctcagcttagcagtccagtgttccctccccctgaatccctccagactgcccaggctgcatctgcctcagacagccgggtgttcccaagacatgctgcactttcttccctctctgatttgctcatgctgctcctcttcctggaatgctcatccccccaattatggaaatcccactccccactcatccttcaaaaggctctggacaaaaggcacattctccctgaagtcggctaccctcccgactctgtaaatttggaataaatcacatctttcagcttctatagcactcaccctgcatctccaccacagcccttatgacatagctgttgagaaaggtctgtcttccttggtagatgatgaggtcattgtggaaggttcgagtcttacttactgtgtccacagcatttggctcagggcaacagtcaacagaggcttagtgacttagacacttgatggtagagtatggaaaactgattctcatgaggaaggtgcttaaggtctttggtaagcctgggaaaggggcagttggctggaacagagggtgtgagaggagcaggtaaagctggatccagctctctttcagcccaaggcaatacctaaaaccctatctctgacttggaaaggcagtatcctgctgtcttcctgctgtggccatgagcctcactggggcttgacttgaatgttaggactttttttttttttttgagacggagtttcgctcttattgcccaggctggagtgcaatggtgcgatcttggctcaccgcaacctctgcctcccaagtagctgggattacaggcgcccgccaccatgcccagctaatttttgtatttttagtagacatagggtttcactgtgttagccaggatggtctccatctcctgaccttgtgatccgcctgccttagcctcccaaagtgctgggattacaggtgtgagccaccgtgcctggccatgagtaggttctttagtggtgatttgtgagattttggtgcacccatcacctgagcagtatacactgaacccaatttgtggccttttatccctcacctgcttcccaccctttccctctgagtccccgaagtccactgtgtcattcttaatgcctttgcatgagagggaaggctttttaaagggcccttttcaaggtttgaaataaggctccatgacaatggcctgatttggatgggtcttggaatacccttttttttttttttttttttttttttgagayggcgtctcgctttgttgcccaggctggattgcagtggcgcgatctcagctcactgcaagctctgcctcccaggttcacgccattctcctgcctcagcctccagggtagctgggactgcaagcacctgccaccgcgcccagctaatttttttttgkatttttaatagagatggggtttcaccgtgttagccaggatggtcttgatctcctgaccttgtcatccrcatgcctcggcctcccaaagtgctgggattacaggcrtgagccaccgcgcccggcccggaatacccttaaaatatagccagaaagggctgaggatgggtaagaacccaggatatagagtcttcccataaaagggagggccatcatgcaagatgaacaacttggtcctgatatggatggggctagaatctccgtattgttgctaataaggtggaactgaatcccctccctgttccccaacacaataaaacttcagtgtcgtctgggtgcagtgactcacgcctgtaatcccagcactttgggaggctgaggcaggtggatcacctgaggtcaggagttcgagaccagcccggccagtgtgatgaaaccctgtctctactaaaaatacaaaaaattagctgggcatggtggcacatgcctgtagttccagctgctcaggaggctgaggcgggagaattgtttgaacctggcaggtggaggtgcagtgagcagagatcatgccactgcactctggcctgggcaacagagygagactctgtctccaaaaaaaaaaaaaaaaaaaaaaaaaaaaaaaaatcttcagtgcagggcctgtctgctctccagggaaggctgcagtattgtcaggtttgtttctttttccccacaaaactgcttcggagagctcttaggtcccaagtttgcctgcatccagggtccagatgcttccagggtccagatgcttccagggtccaggcagtgagtggaagtgaaggaggctcctctagtgaaagaaaaaggcatccagtgttaatagtatttcttcccagttgcatggggcttgcatattagagataaaggaaacatcttwgctactactgagccataagtggtctcacctttcttgaaacataaggccgtcttggtttgttgttctgttttgtgcttttcacagaggcatggacactgaaagacgtttctctgacagtggagatataggactgaagagtgacatggcttgcagagcactacctgtccccctaatccacactgtcctctctcctcatgggcagcctgagaatgtggacccaaggtagcccatcatgcagttcttcatgaaatctggaaatcttggcatttcatgggaaatctcatcactgctaaagtaggcttagatttgttttaaaaccttgtgtgggctgggtgcagggcattttactcttctgtggtaggagagtagactggccacagcccagcccagaatccttaacaaaaggttaagctgctgggcgtggtggctcacacctgtaatcccagcactttgggaggctgaggtgggtggctcacctgaggtcaggagtttgagaccagcctggccaacgtggkgaaaccccgtctctactaaaaatacaaaaattagccaggtgtggtggcgggcacccataatcccagctacttaggaggctgaggcaggagaattgcttgaacccaggaggcagaggttgcagtaagcagagattgtgccactgcactccagcctgggcaacaagagtgaaactccgtctcaaaagcaaacaaacaaacaaaaaaccttgtgtgggtgaatcaaacacgtctgcaagcctgattcagcctgtagcccaccagtttgcagcctttgtttagatccgtagtggagaaagaggttaaagctacaagttaggacccctgaaaatgaaagatggtttggaagtgaatctgaagtaaattgtcactgtatggtttcagaccgttttctggtagtwtgtgctgtgtgacacaggttgtccctgtgttgtgcagtggttttgagcacaacattggccctaggcctgcagtgtggggtgcaggccctctgctgagggctgcagatgctgccgggagtgcagtggatgaggtcctgcccgcacagcctcattcggcgttgatacccatgcctggaggatgtgggctcatcttcttgggtcaggtgagcctcttacacctgtgttcattgcttagctcttttgatgtcattgcatattggttcaattacttttcccttttcagagccatgaataataactatgattttgctagagggaaaaaatgaaatgatcaaggtaatgcatttacatgttacataaaattcatatcatacagaaaggcagaaggaaaacagggagaattacttgttcccttttctctcttcccctcccarttcctttaacaggaagaatgtctcactagtcatgtgatctacagcaaatcctttaacctcttcaaacccgcatctcttatatgttacaggacagtaataaaacttaactcatattattgttattttttatttaatgtggattaagttagttggtatgaaattctccaaatcctatgcatatataaagggtgctcatagagcttttttcttcttttttgtatatccaggatttctttagcggtcttttgtaattatagtaaaagcactgaggttagatttatgggttttttttgaggaggatagactgaatccctttcccgcctcaaggctatagtgggtcggcacagtttgtgtttgctaaacatatctttagctgcgtaagagaaagaaggaaaatagtaaagatgaacagtactgttttctacttgaagttctagttggcccccmctcccttccatgtaggaaccttagcttgctttccacaccctcccaccactggactcacaaaggcccctgatgagtgcctccggtaagacagggggaaatttttatcttaattagaaaaaggcttagtatcttgattgtatgttctctggagccagtgatagagatagtataagaaattctggacattcaaatgtaaaacagattaatttgtaggaatgttggatttttatctggacagatgttttgtcttttatggagttggttgggattaagaagtgggggcagggtcatgttggtattttatttttgctttgggcttatgttacttaggattaactttagctgtgtataacaacagcaacaaatcagatttatagtcagttaacggaggcttaagtgatgtaaagttttatttctctctcacatagaaattagttagaggtagtagtttagggctcttagagsscccaggctgtcatattctacctgcttacacatggctttcaggatctaggtcacctcacagtccatgatggctgctggggctccatcccccttgtctgagtcatatgttggcagaaggaggaaaggcacagatcaagaggaggcctttcagctgggcgcggtgggtcacctgaggtcaggagttcgagaccagcctggccagcatggcgaaacaccatctctactagaaatacaaaatttagccgggcatggtggtgtgtgcctgtaatcccagctactaggggagctgaggcwggaggatcgcttgaacctgggaggtggaggttgcagtgagccgagattgtgccactgcactgcagcctgggcaacagagcgagactctgtctcaaaaataaataaataaataaataaaataataaagaggaggcctttcctgctgcatcagctctctctgagcagcgttcctgggaagttccatggaacacttctgcttatctcattggtcataactcagtcagatgcacacactgagctgcaagggaggctgagaagtatagtctcttagtcccagatacaatatgtataaaattcagaacaagggtccttttactaaggaggaggaagagactggatgttatggatatgggcagcaagcagtgttttcaaagtactgaaacagattgtagaactttgtaaactggctgcctttctactcctctgctcacctctaaccaaagagccacctaattgttctgcatggtgaccattrcctgttagattcttggtgaatagattcctagcctcatcttttkttatttttatttttttaataaatggtagaatgaggatgcaggaaacttggaaaagcagagtcaaagttcaactagcacaggagcagaaggtaaattctgttggcttatagaatgagcccagaccctggtgtcagaagacctgggtcagttctggtctgtcctctcctgggactcagtaaagtctcttggctctctgagctttccacatcagtaagatggggaatgacaacccttatgggactgcagtgaggcttagccaagttggtgctgtggaaggccctactggattccaaagcatgatacrgatgatgaatactttatgtggctgaggtgcttccagcaggcacgtgggaagcatccatgtaagattggggtcatgcaaaatggggtgggatcacatcgcgggatgaagcacttggatgcaaaggcctgtgtggtccagcctgagtctggctcaacacacagggtyggatcctggctgcgctccttactgctgtatgtacagatttggctcagagggaatgcaggattggcaacatgcatctagtctttcttgtggtctcctggtgcctctcatggtgtgcttattcttattctgctacggagagtgtgacttaagcatgtaatttgcatatagcgtggctcctgaatgcaagccactaacccattattttacttagtaagttccagtgttggggcttgggggatggtgtgtcctttgccagtgaatgcttatgttggtacatttcaagggttattttgcttatgcaccctccccacccccgtcaacgttagagcttagcatcatatgaaaggcagtgtccctgtgactgtatcatagggttgatgaggatgaaatgaagtaactgcaggcagtgtccagcccagtgcccagtgctctgtccaggctcagtgagtgacctttgctgctgctgctgctactgcgtccagctggctacatggggctggtggcagagggtgactcagttctcagtgtgtcttttcctgccccctgccaggttgcttcccctagcctagttccctttttttgtgaaatgctcatccctcagctctggacttcaatgtactgttggtttcaaaaccttatgaaacacaacatcaatgggggaagggagaagagagaagctgagaagcctaacccaactctgacagctgagcggctacagaggacttctcagttgggcttcaatacttcttaagaactttcaagttaggcctcagatgtgattttgtttgctgactttctctttgctaccttggcttctatttagttaacaaatctaggccgggtgcggtggctcacgcctataatcccagcactttgggaggtggaggcagaggtgggtggatcgcctgaggtcaggagttcaagaccagcctgaccaacaaggagaaaccccatctctactaaaaatacagaattagtcgggcgtggtggcacatgcctgtaatcccagctactcgggaggctgaagcaggagaattgcttgaatctgggaggcggaggttgcagtgagccaagatcatgccattgcactccatcctgggcaacaagagcaaaactccatctcaaaaaacaaaacaaaaacaacaaaaaaccccaaatctaattcattcattcagcgtgcacaatttattcaacacagtttgttccaaacactggggatatgccccaaacagaccaagttccctgtttcatggagcttacgtttggtggaagagagacaaatatagaaacaaaagtgtaggctgggtgcagtggctcacgcctgtaatcttagcactttgggaagccgaggtggggagatcacttgagcccagaagttcaagatyggcttgggcaacatagtgagactccgtctctattaaaaaaaaaaaaacaagtctaacatcaggtagacttcagggctgtgaaagaagtgacatagggtaagggaatacagcgtgttgaggggatgggtgctattttccaaggaaagcccctcctggtggggggccataggaaacagctggtgcaaaggcctggaagactcactggcatctttctggaatarcaaggatcagcttggtgggaagtggaatgagctgggggtggagtggggtggggtggattttggagtctgagcttgagatacctgcttggagatgctgagcagtctgcaggaaccaggagcccggagctgagggaggacatgaaggctggaattgtaagtttgagagaaatcagctttttgaagctgtgggacggggtaagatcaccgtcatgtgagaggatgggactggccaggtggtgcatgtgtccaggctcagcggatgttcctgggatacaagtacctgttcatcttgttgacatctaatctgtatctgcgcatagtgaccaaggataagccactgagctgctccaaacgtgtgctatgggatggattaactgtgtgggtgtggaaatccctcagaatgatgagacagggagcagtggagaggaagacagtcgatcattgatcggtgagcctgtacttgagatctggcctggatagttgtgatggtaggtggtacccacaatgatggcccttcaggggatttgaagattgtgaaggaggaccaagaggagctgtttggaccacctgtgatccaaggcrggaactaggaagacacctaccggaagtctttgtggatcttttgggattggattggattagcagatacagarcgtttgacctatagtaaccagctgactgttcagcaaacgcttcacttcctaaaaggcttcttctttccaaggcaaactggggcatgtgaggaacaggaacttacaagagcttctagtctgaactccaggtgctgacactgttaacagttgctgagtggagtccttctcacttgggtggaaagtaacctgtaaacttggcccaagtctcccttttcctgtcctttggcccatgctgttctggtgctagatgttggctctggcctttgcactgaccatctcctcgagatggcacgtggggaggatgtgctgtgttgagaagaacttggctggataggcaaagacttgagctagaaaaagaacaagtggttattcatttggtgcttccctttaaccagggcctttttttttcttttattttaaaggaaacctttaagaaaggagggctctcaggcctttcttagaatttaggtctcagttttacatcatgggattctgtttttcttgggtttccattagaagattaaataacatagtggctatgaaagcatactatagatactaggaactgttgctttgattgtgttaaaggatacctctattccccaggtcctttattgattcatcttatttttatttgtataataaatcattagaatagtgcctggtgctctattgcactcacktgcatatactgtataaagctttgtacatattacttgtttagtcctcacagcagccctaggaggtaggtactattattttgctcattttgcaggcaagaaaacaggcacagacagttaaataaggtcacccaactaacaagcagtagagctaggatttgaactgggggagcctggctccatgttctaggttcttcaccattatactccaaggcctgtcggttttcccatcaatctctactgaagaacaatggcgatggccatactggtaattgttgtgctttatatgctgtgcactgtgttgtgtatttcagatgcacgaatgagaatcttcatccccgcaagatattaagagcccgttttacagaggaggaaatgaaggctcagagaattgagtaacttgcttgaagtccaaagctgaggagtggagccagaattcaaactcgagtttgtctggcttccgaatcstgctatttcctcagcacagtggccgtcctccaaggctgtcacatgttccttccctggtgattcacggcacctggctacctccttttagactcactttgtggcccatggcacccagttgtgtcatgacaggacagtggctcccatttctccgggcctgactgtgaggccacatgagccaccccagggaggccagcagagtcagagcttggctttgaaagctgttaatcgacctgagcccctccatgtcccttgctccattttaagcctagggctttcctaaagcaccgcagatctccttttcttgtgagaagagattaggcagatgtatacatacacggtaatgtgcaagtgtctagtttcttgtcagcatcgggatgagctgtttgtagtgaagagcctgggcctggtgagcccccgggatgatgggtggggaccatctgtgctctcctggaaaggaaattgtggtttctttcttttcttttttctttcttcttcttttttttttttttttttttttttagyttatgggaaagggagacttgtgtctcaattgagtctttgtggcgttgtattacagagagtcacagaaaatgttctatgtaaatgactatgtgctctgattagagcctcaatgggcaccattgtgtcatattgctattattggcgattgcaggatactaaatgatattctcatcaggctgaaaaacttcagtgttagcagtgaaactcggggttaattatactgctctgaattagagcatggaattaagttgtagggagagtaagcctattgctttcttccccctctgtcttcctcttcaagattcttgctgggggtttgatcagaatagtttttaacccatgttctatatctgtactactggcattttgttctccatgagttactaccccatttggggttgggaaacacaggaccaatttataggacagtgggagaaggggagacatggtctacttaatagtgcattcttctcagtcaatagctgggtaaaaaatagcatgaagattgaagtcttaggggaatgctggactctctagaggggcctctttaatttagctcttgtctcttctgcctttgaattctcatctcttctgatcctgactcacctctttgaagaaatgacacactgacctacatcttggctgaaacagatagaagagtctatctctgttctgccccttcttggcattcccagcacagcctccaagggagtctgtcccagagctgaggcaggccctctcgggttgcatgccattgacttctcagctttgttttaactgcagagtttccagtgctctgctcttcttgaattgctcctgattgtcaccttcttgcattcctttctctcatttctttttctgtaaatttcatgtcactggtatcaggtttaaagtcgtattttttaaatccctttcaatgttacgtgggttgtaaatgtaattgttaatattatttaaaaatttttgaaaagtgatttttagtggtggccttatcatatctacatattattactccmccattttgggatgtttaggtcgaatcctggttttttcttcttttgctgttgtaagtcatgtatattggcaattagcctaggagagattcctagaaatgagttcactgagaatatgagcttaagagaaagtgaggatttaaagccagatctgtctgccttcaaatccagcgctctttmtactgatgtgagttctcctgtcttttttacctatcagaattctagaactctcccagagaaaccaggcagatactgctccacaccggtgagctgcttctcacctgggtagtctagggtggtttgctccagaattgtatttctgctttttctttttttaacttggcagtggttaaccattccctggagcagcaccaggtaagtcagcttgtatcagagtcatctgctttacctgacatgagcacacgttgtcatatatttgcacatgcagatatcatatgttaaacaatatcacattgttgaagaaaattacactggaaagcgtaaaatatagtttggatgccayattgagtgtaacttaatccacccgattcagaacttttgtagagtgcctcggagttcctatttggaaatatcagttagcagttttagtcagtagagtaacatattttctatatttatgatatatcaaagagactttctgaagcagaaccctgattgactcaagagtcttttccaaattctgtattctctcagaaccaggatttaataggaggtgggtggggggtggtccttggtcaaactggggaaaagcctcataatgagattgccaaagcgcttacagcatttgaaggctcagagagatgccgtggtcaggaagcttgtttgagtctgtctggaagccagtaagtcccacagaatacctactgataatcctgtggaataagcagcatatggaatgttgctgagctagaattaaagtccacacacggccaggcgcggtggctcacgcttgtaatcccagcattttgggaggccgaggtgggcggatcacttgagkccaggagttcgagaccagcctggccaacatggkgaaacctcatctctaataaaaatacataaaattaggtgggcgtggtgatgggcatctgtaatcccagctactcaggaggctgaggcaggagaatcgcttgaacccaggaggcagaggttgcagtgagccaggattgtgccattgcactccagcctgggcaacaagagcaaaactctgcctcaaaaaaaaagaaaaaaatatattccacacacctagtttttcagccctatacaggctgaccccatacctgccatctccttttcacttcctgttctttctggcctccgtgagtccacgtgtgcccttgtctctgcttgctgtgcctttctctttcctccacgttgctaaattccgtccatttttcaaggctcagttcagatcatycttctttgctttatcattttacatactgtgtatggtttggcctcttggtctgctgctctctgtgtctgttgtatggagcgcttttctatctggtattacggttatttgtgtgcatgtcttttgattcatctacttgaagacaagagctggtcttgggctgccattcctgcagtgtaggctctcacattgccttgcacgtagtaagtgctcagtaaatgcttggtgaacaagtgttcatggcgtaacttaatacttccagtggtgagagttcctgtcaagagtgttggcagtgaagttgttccccttggcaatttctatgctgatctcgggttactgcatgagacacagaatctgcgtttccctccmttcagcatcactggggaggacagccttactttggagttttttttctgatcagttacatgatggtttcatctttaagactactgataacaggcagctctgcctatggagtagccattcttttttttttgagatggagtctcgctctgtcacccaggctggagtgcagtggcatgatctcagctcactgcaacctccgcctcccggattcaagtgaatcttctgcctcagcttcctgagtagctgggtctacaggcgcacgccaccatgcctggctaatttttgtatttttagtagagacggggtttcaccatattagccaggcagtagacctgcagatctcatatcatcgccactgtggtgcaatgccctcccaaagtgctgggattacagacataagccatggtgcccggtggagtagccattctttatccctttactttcctaataaacttgctatcactttactctaaaaaaaaaaaaaaaaagactgaccaggtgtggtgactcatgcctgtaatcccagcactttgggaggctgaggcaagtggatcacttgaggtcaggagttcgagaccagcctggccaacatggtgaaacccccgtctctactaaaaatacaaaaattasctgggtgtggtggcgggtgcctgtagtcccagctacttgggaggctgaggcaggagaatcacctgaacctgggaggcagaggttgcagtgagctgagatcataccactgcactccagcctgggtgacagagcgagagtctgtctcaaaaaaaaaaaaaaaagaaaaagactattggtaacaaccctcatttttttgagcacttgctatgctgctaactgctttatgcacactatttctttaatccttaacactatttctttaatccttayatctacccatgagatagggttttgttattcaggcagtggcaaaacctgcggcttagagaggttaaaaaaaaaaaacaacaaactgcctcaaacaaagtcatatagtaaatggcagtgctggagattaaatttaggtctgtcttgttctgcagtccatataccatataactttgccaaatacaacactatggtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcctttcctgtctcttttctctttctgaataacatcatttctttttctctactggacatggtctctgtgggtttcacccctcacccctcttatttttgaagttttattgaggcactggttgaggctttagggctcccactgttaagtttgacagtaataggtaagtgtccccccagtctcccttttgccctttctttttttttttttgagacagagttttgctattgtcatccaggctggggtgcagtagtgtgatcttggctcactgcagcctcgcttcccgggttcaagcgattcttctgcctcagcctccccattagctgggaatacaggcgcacaccaccatgcccagctaatttttgcatttttattagagacgtggtttcaccatgttgggcaggctggtcttgaactcctgacctcaagtgatctgcccgctgcagcttcccagagtgctgggataacaggcgtgagccacaccgcctggccgcttttgccttttcttgacatygccaatgcatcctgtccccgagcgtctctgagttttaagtctcagatttgttttctttggagacaaactgcaggtaggtgttacttctcaccgaagttcccagatagcacaggctttgctaaacaacacagcaccaggaactccatcatagagaccgcaggatgctgtgtgcgcrcacatgcgtgtgcacctagtgagatgtaaacatttacctggagtaraagaaattctttccccagagcccaaatttggctagtctccttatgtacacagctttgacagggattccatatgttttgctcatctttgcttttttgcagcctccacaaatttattttccgtaccactgccactaaacagagttgtttctaaagtgcagatctggttgtgccattccaccgtcaaaaattattttttggctccttgttgccttcagggtgataggacaggtgrctgctcacctctccagcttctcttactttctttcttcttcttcttcttcttttttttttttttttgagacggagtctttccaggctggagtgcgatggtgcagtctcggcttactgcaacctccgcctcctgggttcaagcaattctgctgcctcagcctcctaagtagctgggattacaggcacctgtcaccatgcccggctaatttttgtaattttagtagagatggaatttcaccatattggccaggccggtctcaaactcttgacctcaagtgatctgcccgcctcggcctcccaaaatgttgagattacaggcgtgagccaccatgcccctcttacattcttttcttctgttcrctacagccgtggagagctccgggttgtcctgcacatgtgcactgccctctcttttatggaccttttaggctggctgcaccctccgtctgtgtcaccctcctgctcctcctccacctggctagttcctgttggccacttttggaaattcatgccagtccagtccaccctgagtacatcctckttctgtgtcactgagctcactatgctgggttttatctatgtctccctcgcaactagatcattcacgtcttgaagttaggcatcatgcgttcttcatttctgtacctcccaactcaatgcttagcacccagcaggggctcaagactgtgtgtggaatgaaggattcgtgtgaaaatgcagggagatggaaggctgagcgtttctgttccttgaccattcccgggtttgactaataactctcatacacactgctactcattgaaggcctactgtgtgcatgcattccatgtgtgctatacagtttatttattgttaacccacgtagaattcccagacacatagcgttactacaaacttcatcacaaaaataaagaaaccagggccctgtttctctttgtttctcagatgagaagtctcaccagagttgactgtggcttctgagcattatgaggcacatgtaggatttaaagctgaaaggctttatccctgagactcagggaaatatgacaatcttttattttgttttaattaatattttttgagtcagcgtcttgctttgtcacccaggctggagtgcagtggtgcaatcatggctcgctgcagcctcaacctcctgggttctagcgatcctcccaccttagcctcctgagtagatgggaccacaggcacgtgccaccatgcctggctaatttttgtactttttgtagagatggggttttgctgtggtctcaaattcctgagctcaagcaattggcctgactcagcctcccaaagtgttgggattacaggtatgagctaccgcacccagcctgacaattttttaaacagaattttaggtgcttgggccctggaaggttcccagttgtccaactcttgaggtggggggtgggtggggggtggagagagagagagagaggaaggcttttccttctcaaatagtttgcatttacacgaaggccacggtgtacttgtttattgaatcaataaagatacaatctctttgaatagttcagaatctgatatccctgttagactgagttcaccttttgtgaaggacacaggactgctggatagggtgttgcagcaatgaggagttatgttataaggggtctcttcagtgtctttttggtcatatgaattttatttgcccagtagaacatgactgatgaggctctgaatagtcaaagaaaacatctctcttatgttctgctcatgaatagaacactctgtgtcctgaattgttgctccactggggccagcacgtggtgtatttttctaatgtttgaaccaatgggctttttcattttggggcaatcaaggtaaagattttctggtgctcctgtgtgacagggaaagcatgtcttgtattttctctctctttcccttctgtcttttgagtttggaaaattatattttgagttacatgactaattacatgastaattttagcaaatttactagaaattgatgttctgccaatgattggaaatcccttcctcccctccactcttctaaaccaaaacagtgctgtgtcctgaagctagaggggtgagtattcagtattggagtacagcggtttagaacattggagacatttacaaggataaatctatggccctgggttctgactttcttttgcctgtgtgtgtgtgtaggggtgtgtgtgtgtgtgtgtgtgtgtgtgagagagagagagagagaaagagagtaagagagagcgagctgggtttggggctgggaaggaagaatgattgattaggaagctgttgtgcagagtagaacaggacttcctgaaatgtaagacccaaagaaacatagatagccatattttccagtcctggaatcagactcaagtctgataaaaggttttcttttgatttgtgattctgataatatgaaaagtcttacaaaagtatagaattgtagctggtaggctgctttatgagaaagaaaataaactcccacagagtgggcattgacctgggagatctggagcctggtgcaagtgcagaccatggttttcacaatctttgatcactttccttttgtgttgaactttctcttttagctccatatttataaatggggtcatatttagccagatattttatttttatttttatttttaaagagaggcaggatcttgctgtgttgcccaggctggagtgcagtgccatgatcatagctcactgcagcttcgaacagggcacaagccatcctcccatttcagcttcctgagtagctgggattacaggcaggagccacatttcctggcttctagttgggtttttttgtttctggaagaacagaaccatactcctcaggccaggaagacctaggtagagcaagaccagcaacctcttggctagagggctgtgggagctgagcatcagtgagtgaggggaaagcagtggttttttgtcttgagaagaagttcagcgctcagttaaccagaacaagtgccacctgtataagacagcagacggtcaaagcagaagagggaaggaaatggttgaataattctttttttccttttgttccttctctgccctgagtctcccccacccccaaagagatatctcaaaatgtcaaggtccagtgaaatggacggtgggatccttgaggaggggtctgtggggtgggggtctctgaaggggctaagccatggtgggctaatggctctgtttaccgagtgcatgccctatgcctggcattgtgcttctttctcgaaaccatcctacaggtggaggaagcgggggtttaaagggagccagcagccagcgactctctatcttacagcttctaattggctttgaaaccacacaggctgctgctggaggaacctttgacatcctcagtgtgcagccctctcccctccctctgaagggaggcatactccttcactgttgctttgacactctaggatgttccaaaactaggtggtcagcttactcagaaggctctgggcatttttcctcctgcaggagggactgcgcacatgcgaaagacatgaggaagctctgatgctcagggctgtgggggctttggccttggcccgcacagccttctctggtatagtgaggtctccttttgggtttttcacttgtgtttgttttgaggcgtatgtgcttcatatggttgaactcattcctcgcccagctggacatagagttgactgcctcagtgggtcccacctcgggggtgggaaatgtaacctcatgagggccactgtatggttgggcagattcacagctgctctgaggtcaggcctggcaggtggcgagggcctaagaggaattggatcaccctggaacctagctggggctaggatggttgttgcatgtgattttcagcaggactctaagggatctccaaagctggttggctggctagygaggttgggcgagggaataactcatttgcttaacttttcatatgtaacaactgggttttgggtttcacaagagacaaggtaggcaggcaggctcaggtggttctgtataccccatttcatacatgagaaaatggagacttgtttcagatcgtaaggtagttggaccgcagctactcttccaagactggtattcgttcctctactctgttaaagccagagagaggatgcaggccaagtcaagtgaccaaagctaaaggggaaggaagggctggctggacttagcagtgaccacagacagagttgaagccttcacggttggcgttggycttgttcactgctgtgtgccaagctgctgacagcatctggctatcgcaggttcgtaataagtgtttgctgagtgaatgaaagaatattggtgttggggatgatctctttttcacttgctcagcaccttccagaattttgttcttctctttgccactcccttttttctcctccctgggtaacacctcttattgcaggagtaggatcaggttttgagtagcacctttggggtacccattcagttcctcttttcccccgtaattatgggatttgggattgccctttgggagaattaggtaactttaggttctgtatgttaatttgaggcctggattttgaacttccttctgatgcagatagaccttggaagggagtccttacttagaacctctttattttatctcctcactgggagagtagatcccagacaggttttgggaaccacctggtgtccccaagcgagcagaggcagagttgggcttgaatctcctccttcattgcagtgctttctctgccctgatcccattgggtgaccctggactatgaatatggattatgagtgggccctgagagtgatcagagacatccttcaagattgaagctgctttggttcctgccacatggaactgagtgggagaatgtctcaattcaggatggtgggagtgtctctttgtccaagtaataaatggaaaccgtttgctcccgacttttgcagatatcaagggcttgtctttccagagtttggttttcttcccttctctccgcctcccttttctctgcccgcctgtggttttgagcccctcatggctatctgggcagtgatgggtggaagggagctggtgcagtattcgagtagagaagttctgctgcagtgagtgtggggcaagtttcccagacccttgttgggtcagggcaggtggttgtggcccagttgtttggccttctgcaggctgcasccctgccctgctgcctgccagtggggtgagggcctggccacctggtacttaacaagtttggttctacatgtgttcccgtgagtggaggacaaaatgaaaatacctcctgatcgtgttcaaccattagttgaacaaccatttgaaatggttattgcaaccatttcagagttttcttctgtttgtgatgtcatctgtgccttataaggggtgacttgctaccttatggagcacctaggttgaggcccgggttgagcacagttccatacgttagctcatttatttattttgagacaggatctcacttctgtggcccagggtggagtgcagtggtgcaatcacagatcactgtagccttgacttcccaggctcaggtgattctcccacctgagcctcccgagtagctgggactacagcygtgtaccactatgtctggctaattttttgtatttttagtagagatggggttttgccatgttgcccatgctrgtcttgaactcccggcctcaagagatcctcttgtctccaaatcgcttcgcagaagtgctgggattacaggtatgagccaccatgcccagccaagttagttcatttaatcttcacagtggtacaatgggctaatatctctgtcttataggtaaggaaatggagactaagagctctttgccaagggttgctgtcatccatttattcatcaacaggtagttattaggtatctactctgtgctgggccctggcctgaacttggctttggtggatgagactgacaagttcyctgttctcacagagctgagagtctggggataaagatcccttattatggtttcttttgtggtgttgtggggagagggtgatgattagggtttgggtactggagagagaattaggattttagctcattttactcaaatgctttatattgcaccatgttactacattttcccctgtgcttcccccctaccctatgtggattattacagtttacttgtgtgtaaacttaggctcagagaggctgggtaacttatcccagcttgcacaaaagaggacctgaatttgagcagaccgtaggttgarttctgtccttctatgctgcctttctatgaataatatgtttacatatatatatatatatatatatatatatatatatatatatatatatttttttttttttttttgagatagagtcttgttctgtcacccaggctggagcgcaatggtgtgatctcagctcactgcaacctctgcctcctgggtttaagtgattctcttgcctcagcctcctgagtagctgggattacaggtgcgcaccaccacgcctggctaatttttgtatttttactagagatggggtttcaccatgttggccaggctggtcttgaactcctgacctcaggtgatccacctgcctcggcctcccaaagcactgggattacagcatgagccacagtgccaggccttacataaaaattgtttaaaaagcagtttgcagaagaattatcaatccttttgttaacattttggtgaactcttgaacacattttttaaaaagttgagagttgctaacaagtaaagtgaagtcctgtgcctgttgtaatttggactgaggagtgtgagttgtcttggtctaaaggtcagagtgagggtctctgcctgctgcaggggtctcccggttagggttagggtgaaaagctttttaaaataaacctctcaaatttgttgtcaacattaacctatggtaattttttttttttttcttttttttgagacagggtcttactctgttgcccaggctggagtgcagtggtgggatctcagctcactgcaacctctgcctcccggttcaagcgatcttcctgcctcagccccccaagtagctgggacgacaggcgcgtgccaccatgcctggctaatttttgcacttttttggtagagacagggttttgccatgtcacccaggctaatctctggtaatttttaaactctgctcaaagttttagaaaacataagtctggaaattccaagttgagccactggtgacttgtgagcatgagtatggcatgggattgggggtggggtggggctgacgtggcctggggcagatgccgggtggttctgtttggaaacagaagttccactgcacatgcagccttcacgtcttgtgggggcttttgtgggggctgtgtacttcccagtttggttattagtaactttatttggttctggtcattaacggcttttgggggcgttttgggggcctgtttgaggcccctgaacatgcatttttcagttgtcgttgtccatgttattaaaaggatatgttggagggggttgcagtttagtctgctgctgtttcgaatccttttctttgatagtgtttgccttcctcccaccaaatgctgcactgagagtctctggtacctgggtccctccttcccttgcctttgcttgggaggtcagtgccttcatccaggacatctttgggcatacaggtaatcccaagcagctctgctcagttgttgataccccttctcacagaacctgatctgcctcagctctccttgcctcctaagtggcagtgccccgctgctgggaagactcctctctctgctggatgcttcttcaggcctgctgctgcacagcttacggccatgatgactgctgcagtgcagaaggcatttcagttggctgtttgtttttcatgcattttgtgtttgtagtgtgctggccacgggagcactctaaacacattatgggccgggcgcagtggctccggcctgtaatctcagcactttgggaggctgaggcgggcagatcacttgagcccaggagttcgacaccagcctggccaacacggcgaaaccccgtctctactaaaaatacaaaaattaaccgggtgtgatggcgcgtgcctgtattcccagctactagggaggctgaggcaggagaatctcctgaacctgggaggcagggactgcagtgagccaagattgtgccactgcactccagcctgggtgacagagcgagactccatctcaagaataaaaataaaaacaaaaataaacataaaaataaacactttatgtacacaatctcacatcactttcacagtcttggaaggcagatatttctgttatcctcattttacagctgaygcctatctaaggcttgtataaaagtcagtcactgtccaggctcacacagccaatgctggagggctgtgtggcacccagagagcacagttgctgcttggaataaaccttcacttatagtccggagcagggkggttctaaagctcccttagctttcccactagtaagcttccaggttctggtacagtttctcagcctcggcactactgacgtttggagtctgatgagtctttgttgtgagcgctgtcctgtgcattgcaggatgttaggagcatacttggcctctatccactagatgccagtagcacccccctcccaactctgcccagttgtgacagccaaaatgtctgcagacattgccagatgtcccctgggggacaaaatcttgcctaattgagaaccaccgagtcatggcaaccatttcaaaccctaagccaggatgtacgtggagatggagaaaggtacaacatttagaattggtactgttggctgggcacggtggctcacacctgtaatcccagcactttgggaggccaagacgggcagatcacctgaggtcaggagttcgagaccagcctggccaatgcggtgaaaccccgtctctactaaaacaaaacaaaacaaaacaaaacaaaacaaaacaaaacaaaacaaaacaagtcgggtgtggtggcgcacttttgtaattccatgtactcgggaggctgaggcaggagaatcgcttgaacctgggaggtggagattgcagtgagccgagatcgcgccattgcactccagcctgggcgacaatagtgaaactctgtctcaaaaaaaaaaaaaaaaaaaagaattggtactatcttagaaaacctggagcaccctgctgctttaactgcagccctctgtgtgggcagacagattgacagtgggcttaatgtggggtaacctttcatcatgaaaattaaattacactgcaggccttttgtagccctcctatatgaaaccctcttaaaatattttctttttgcaatggaagcttgggggaaaaatcatagtcttagatttattgaagttttgtggataaaagcactttttattaaaaagaaccaggtgaaaactagaagggcctcttttgagtctgctgacagacacgtggagaatatatagtcagcggaacattcctgtgctttccgtaaagctgtggatgaacctgcctttcaggtttcgtagcctcttcagtcagatggtttgagaatgcgtgttttgtggtgtatgcacacagactgtatgagtttgtttttttacacatgactagtaaacctgtcacattttgtcaaatgtgattttctttctttattaaaatagattttatttttagagtagttctaggttcacagcaaaattgagcagaaggtgcagagatatcccatatacccctggcccccacatatgcacggcctcccccgttagcaacacccccaccagagtggaacaatcaatgaacgtacattgacatatcactatcacacaaagtccatagtttctgttagaattcatgcatagcattctacattctgtgggtttggacaaggtatgatgacatgtaactgtgatttcctcaattcaatatgtatagttcctgttcacacatttcttcacacatttgttcctcagtgctcaaatgcctgctgtattccaggctgtatttgaagcccctgagcctttatttggagagttcattgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttaggcatactttttcagcaacacatgtctgagccgaggtgcactgtgcctctttctgtagcaggcagcttttagggggtgtcctagtggtcttatgttttatacatctcatgggagtggctggtttctaggaaatagctcacttgccagttttggtaaccctaacagagctgttttgccaaggcgtctggtgaatatttctgtcttccagtcaggactaatatagtacttttcagaggtgatagccagttaactgatgactttttttttttttttttttttttttttttgaratggartctcgctctgccacccaggctggagtgcaatgatgcgatcttggcttactgcaacctctgcctcccggattcaagcgattctcctgccttgcctcctgagtagctgggattacaggtgcgcaccaccacgcctggctaatttttgtatttttggtaaagtcagggttttgccatgctgctcaggctggtgtcgaactcctgggcccaagtgatctgctcacctcggcctgccgaagtgctggcattacaggcgtgagccattgcacctggccgtgttttctgttttttatttagaggaagtcacttgatcatgcttttccccccacccatggcataggaaaatgattcttttgctgattgtgctgattaaatgtgatgtggaaaaacctactcctggtgttcagagaggttttccaggtcacagtggggtgggtctcatctggacatcagaatcattatgttaatgataactaagagcagttgactgcttactataagccagccactgacctcagggcattgcataactggcttcctttactcttcacatcagccctgtgggcttgggagtgagacctctacctagtttttaaacaaattacataaactttttggggctcagctccctcatctgaaaatcagaaaatgatacttctctggcattttgagcatgagttcaggagtcagacttcctgggtttgaattctagcttcttctatgactttgagcaaattactttaactttgctaagcctcaggtttctcgtgttgcataggcagatgatagtcatatctgaatgtaacgagaatcaaatgcaacctgggacacagtgaacacttggtgaacgttagtgccttggtaacagtgatgatagtgacaataaagatcgatgatgatgatgatggcgatggtgcttaacccagtatgaaggtgaagtgtctaagcttcttgagggcagagttttgtcttcttctgcactttctttctagtgtctagaattgcctgtaggtttacccctggatcccgtcaggatggggctaaatttagaatttttggaaagatgtgagctagcccgtctacagtgacatccagctcagtgtgtatgtttggtctgtgaacatagtagaggcatgattcaactgtgagtttgtgctgggagcatagatggatgcttttcaggctcttgaaatgtgcaagtgtggttcccttgcagcaggcattgcctctccctcgttaatcaagatcttttccttgccaggacttcaggagatcctggacatcctctggagcccaggggtggcctcacccgctccttgctttagcctggaatgcaggccctcaacattccagccttgggttagtgccagagctgtgaaagcagggcaggcatttccaccttgcttgacaaaggcttttgctctctgggtggttgggggtgcctctgaagccaggcgagaccagagatctcatgggtttgtgtttcttcattgatacttttaaggggagcaacttaatcagtgggaaaccagatctcaaaggatgggacagataaacscagggtacagagaagagcttgggggagtgtcaagcttatttgcccaaaagggctgaccctaccttaccgccattaatacatgtccttcatgcatccctgggtaacagggaagtagtaccaaaaatcttacagtgcaataaacacttggcagaaatggagaaactagtaatggctgagcagctgtgccctctccaccacctcactatgcagtacgtgggccaccagccgctaggggcctggcagccacagagatgagggaagcatgctgaggaccctggtgtggagttggaggggtcatgtcctctgaaaggtggccaccactcatcgccagcccttactgtcatgtgagaatgtggctctgtgtttccagatattgtttttttttttcccctccaacagaagcaggaaatataaaaaatttatataatatatataaaatatattatatataaatatataaatatataaaaataaatatatattatatatataaaaatatataaatatatataaaaatatataaatatattatatataatatattaaatatattatatataatatatttatataatatatataatatattatataaatatataaatatataaaaatatataaaatatataaatatataatatatattatatattaatatattatatattatatataaatatataaaaatataatatatataaaatatatataaaaatatatgatatataatatatataaatatatatgtataaaatatatattatatattatatactatatattatatataatatataaaaaatatatataaaatatatatataacttcacggaaactctgaaggagaggtcaaatataatattatatattttatatatataatttatatatatataaaactatatatatatatttttgagagacagtcttgctgtgttgcccaggctggagtgcagtggtgtgatcttggctcattgcaacctctgcctcccaggttcaagcgcttctcctgcctcagcctcccaagcagctgggattacaggtgtgtgccaccatgcctggataatttttgtacttttagtagaggcagggtttcaccatgttggccaggctggtgtcgaactcctgacctcatgatccgcccaccttgacctcccaaagggctgggattacaggcatgagccaccgtgcctggccaggaaattatatttttatgagaaatattctgttgtttaaattctggcacctcgttcttttttttttttttttttgagacgaagtttcactcttgtcgcccagtctggagtgcagtggcatgatctcagctcactgcagcctctgccttctaggttcaagtagttctcctggctcagcctcccgagtagctgggattacaggtgcctgccaccacgcctggctaatttttgtatatttagttgagatgggggtttcaccatgttggccaggctggtcttgaacacctgacctcaggtgatttgcccgccttggcctcccaaagtgctgggattacaggcgtgagccatggcgcccggccctagttcacaaaatatatatggccaaacaaaacatgtctggggctagacttggacagggggccccattgtgcaacctcttatatagcaaattagagtttaccaggaagtttctgcccttcaggccctctgctctcacagaaactctatgaaggagaggtcatcttgtctatgtttgtaagaagtcacattgagagaaatgacatcttagctcctcttatgtgccaagtagtttgtctgcgttatcttcttagattggctccatctctcaggtgaggaaacagacttggaaaggtgaagtgacttgcccacctagttagaagcacatcatcttctgattcctgtctcatttcatttcaccgcttgtttgccctctctgtggtcttgcccacggacttgtagtccctgatgtacgccaggcctctcacagtgtggcccccgggattcccttttatgaaaaaaagttgagcatgagctgtaagttagagtaggttttaattctgtcctaccacggagtctgttttatatgagaacaagttatttaactcctctgagtgttaatttcctcatttttttcctttctttcttttttttttttttwaagggccagtccccattctcacagggtgtttggaaggagtaactgaaggggggtatataaagccgctggcagccaggcatggtggctcacgcctgtaatcccagcactttgggagcctgaggcaggcagattgcttgagtctaggagttcaagaccagcctgggcaaacatggtgaaaccctgtctctataaaacatgcaaaaattagccaggcatagtggtgcatgcttgtaatcccagctacttgggtggctaaggtgagaggattacttgagccagggaggttgagactgcaatgagctgtgattgcgccactgcactccagtttgggtgatgcagtgagatcccatctctaaataaaaaawaaataaataawgcccctagcatggtgcctggcacatggtaggccctcaaaagatgaccctccaaagtggccaggactcaccatgcattcagggaatatggattcttttggtggcagcaggctgcatttttgcctggctgaatgcctgcaagcatgggaacttttgatgcaacagtaatccttggggtctgaaaggccccaaatctcccgccagatctctgaggttaacatccagtcaaccttttgcttttcattcttggcctctttcctcctcacctccaccagtgtgacagtcatatcctctctatgtttctggtaagttctggccttgagggctggtcttatgactgacaagtgaagagcagtgccaccctctactccacattctcagaagcgtctctaggttccatactttaaggcaggctagcttccaaggcatactgacagacatccctgtgcagtcctgggggcacgagggtcccattccaccctggggcttcagggtcaggtgaggaaggtagatccctgaagttgggtccagaaaaggccactgggctagcctgtctctcgttctggtcactgacctcaggatccagcaggacgctgctagcttgcttggctcagctctgcgagtgctgggagcaataagcagtgctgaaaacgcgatgcatttcaacccaaagcactctgatccctttccaggctttgggagaatgttttttccagctcggttacttgctggcatgcataggtcaatatacaaggtgttctcagagaagccggagctgaatgttgacttttgtgctccctggggtgtgttctggggaggaagtgggttttcaggttgtggtgcgtgtaggatgtggtctgggatgattagtatcacacactgtggataaagttaacacgcattgtggagcttttttcctcttttgtacttttgggcgaaggtgcctcaaaagcagctttgtttatcaaggaggtgcccttgattctgtatgcatttttaacatctgaatagaagttagacgcacacataattgctttacttgatgcagtaaatacgtttcagccagataatccataagaccctagttcagatcctgactttgatccctcttagttgtgtgagctctcaccagtttacttgacctcactctctgagcgtcagattcctgagtgtaaaataggtacaaaaactcagattgttgtaaggtttcagtgagttgttgcgtgtaaagcatttagtatacagttcttgtcacaatgtttagtaatggcagctattatcttaactattagagcggcagtttggcgtggcactaataatgatgatggtgacagtttcactgagtgcttactacctcagctattcktccaagtactttgcatcacttagctcatttaaccctcacaataaagcgataaggtaggtgctgttctaatctctgttttacagatgctaaaactcggcagccaggtgtggtggctcatgcccgtaatcccagcactttgggaggccgaggtaggcggatcatctgaggtcaggagttcgagactagcctggccaaaatggtgaaaccccgtctctactaaaatacaaaagaattagctgggtgtagtggtgcatgcctataatcccagctactcaggagacagaggcaggagaatcgcttgamtccgggaggaggaggttgcagtgagccgagattgtgctatagcactccattctgggcgacaagagcgaaactctgtctcaaaacaaaacaaaacaaaactcaggcacagagaggttaagtaacttgcccaaggtaacccagctcataaatatgaaaagagcagggactttagagtcagaagacctgggtggcacgcttgcatgccgtgtcctggtggtgtggcctaccgcagagtgactgactctgattgccttcccaactgtaaaatggtgctaatgatacagaccgccccccattgcctggtgtggtgcgcggctgtgagtgcttaataataggtgcttaggcatcatttgctaattaactgactgtgttaggttattaggaagttccagtgggctaataaaagctctgggtaaacgttagttgttcttttaaatgtcctgaggtgcttatgattggagtttaaacagcacaccwgtttttcagatttcggaaccacttaagagaggcacagtgtaaagaaggtggagatgagaatatcacctttactcctgatacagtcttggagaatgcagcttagttgtggggcagcattagctttctgatatgaagctgagattaggtggatgtaccaggccagtcacgggcagccttgggtacccagaggccttctcacgtgggtcgaggcaggtggtggaggtggtggcagcggtagcccccataatacttctaggtggaagaacagaccacctgagtgagagaaatcactcctgagccctgggggagaactgtgtggaggggcagatgggagcctggagttttgagggaaaaaaaactttccttttggaagccagacgtagggaagaagcatattgatcacaatgactattaaagaaagctccccaacaccccagcaaaacacccacaaaacaagaaactacttctgccaatggttctagccagttttcttcaccacagttcatgactgcttcatccttttaggtgatcacacccaaaacttttgggtcttcctgcctttttttttttttcttttgagaccaagtcttgctctgtcacccaggctggagtgcaatggcacgatctcggctcgctgcagcctccgcctcmcgggttcaagtgattctcctgcctcagcctcccgagtagctgggattacaggcatgtgccaccatgcctggctaatttttgtatttttagtagagataggctttcaccatgttgaccaggctggtcttcaactactggcctcaagtgayccacctgcctctgactcccaaagtgytaggattacaggcatgagctaccacacccagcctttttttaaaacaaaaccaaaaccaaaagagacagggtctctggtgtgcagtggtgtgatcatagctcactgcaccttgacctcttgggctcaagcaatcctcctgcctccacctcctgaatagctgggactacagatgtgtaccatcacactcatctaattaaaacaattttttttttggtagagatgggatctcgctatgttgcccaggttggtcttgagaactcctggcctcaagcgatcctcctgccttggcctgctaaagtgctaggattacgggtgtgagccactttacccagccttgggtcttccttgactcctgactctcaaacctcatattcagtccatctgccagtctgtgggttcaatcttcaaagcaaacccagaaccttactacttctcacctctccccagccaccgctctggtccaagccaccatcgtctctcacctggattagtgcggggctctcttcctggtctccccacttctgcccttgtccctcttcagtctatttctatgaggccaccagaattatcttttttaaaaactgaagtcagatcatgttgctcctctgctcaaagccccgcagtgattccctggcacgccgaggggaaaaggcaagatcctcccaaaggcctgtacgatctgcccccggcagctccctggcctcttcattttgtgcctcctctgccccctctgcagagccacactggccctggtagtttctagaacacgtcacgttcatgcctgcctctgggctttgcatgggccttcttcccaggcacaacgtggggctctccccacttcttccaccctacagagaggccggccctgatcagctgttttataatagctcctcccgatcagtactcctgatcgctccctactgtgctgtgccttttttttttttttttttttttttttgaggcagagtctcactctgtccattgcccaggctgtagagcaatggcgtgatctcagctcactgcaacctctgcctcccgggttcaagcaattctcctgcctcagcctcccgagtagctagaacacaggtgcccgccaccacatccggctaattttttgtatttttagtagaggtggggtttcatcrtgttggccaggctggtctggaactcctgacctcaggtgatccacctgccttggcctcccaaagtgctgggattacaggcgtgagccactgcgcctggctgctctgctttttacccatagctctggctctaatatatgacactgcccctccctgaattagaatggaggctacagggggatgctggtctgttarttgactgatgcatcttcagcacttaagacagtgtctggcacagagtaggaacagaatatggtcctgtaacaaatactgaaggttgtgctctgtgcacctgggatagagcaggagcaagacacatcattcctgccctcacagggttatggtctcctaggtgacaaggtagtgcacacttccatagstcttactctgggacaagtactgtgccaaatgcttcctcccagccgcctgatgaggtagctactgttagttatcaagtctgatttacaggtgaggcaaagaaaggataagtaattgacccaaggtcacacctagcaggtggtgaagctgagccatgggtcttggcttcaagaatctgtgctcttacccaccatacctgctgctgccggattcaaacccgaattgcattaaggaatcatcataacctgtttgattgaagctataagggaactttgagcatggtgaatggggcgctctatggaaaaggggttctgggaagcctctgtggaagggaggttttgttaagtgaactcccctggtaaacggagtgattggcccccaattagcttgctgttcggattaactgtartacatcacactttcgaaagtgaagatatgcctattttttcccctctaggtctataaagtagatttttgccattagtaaaatttaaagtgattgggggctatggttactgagaattcaagaggtagattgacgaaataatatttgaatgcaattttattttttgaaaaatgttttcgagatgtcctgtttttagccaggaagcaaactccaggaaaactctcttttccattaaagtgtggatggtgtactgtaaacaaagactagctctcttgagctgccacgtttctataacttatagaaacagaagctgttttttttttctaaagatccaaactcatgttgccacacaaacaacaaaataaaccagtgtgttccaaaaacaagcatttgctytacccacacgcacagttggaaagatgcaggtttgattgaagaagtcggaagccagtgaggtaatggcagattcttttaggggctcctgttaattttagtaagcttggaagaagcttctaggttgtttagtgtttctattagaaccatcacctcaacgaatttgttattgtagagattgattaggggatctgcttcctttgagcagccaggatcccccagctccagcttctagcctgcttttcttcctcatctctactctttcagaataatgcatggctttcaagtcctgtgtgataggtggcttcttagcgggcctctgaaggggctgagatttgttcctggggctgagactttgttcctttgagggtgcagaggctgctacctgctcaggctgcccccaaattgctcttgtgtgcagtgtgctgcttggggaccagtcctggctctgccaccatggcggacactactggcttcctcttaatctcaatctcttcttctcctttctttcttttttttggagacggagttttgctcttgttgcccaggctggagtgcaatggcgctatcaatcgttcaagcgattcttctgcctcagcctcccaagtagctgggattacaggcatgtaccaccacacctggctaattttgtatttttagtagagacaggatttcactatgttggccagtctgatctcgaactcctgacctcaggtgatccgcctacctcggcctcccaaaatgctgggattacaggcatgagccactgtgcctggccctcttctcctttctaacacaagcctgcttctcagtttcacgcacacataggagtggccacctgaccctgtgttggcaaatgattgcaggctgttgtcaccggtggggctcctggaaaagccctctatgggggattgactctggcatgactggggtgtggatgctgtgctcagaggtgctgcagtaatggttctgctgctgctgatagtaacacaggcagtgctgtgtcatgcacagtaatcctgtaagggagatactatcatgatctctgttcggtggatgaggaaacagtctgaggaaaggcacctgacctgttcaggccacacactaagtacagagctgggatcctggcaccagcatttgctctcaccacctctctgttatgtacctctcacacaggtgcgagtcccaccccagaggggccttgagaggctgcaagtgtcctgggtgggctgcctgcttcaggaggacttattattggggaaaaatacccccmctacttattactaagggccgaatgctttatgttcacacaacaactccatgttgtgtgactttggacatgttccttaactttctttatcttggtcttctcatctctgtaaaattgggatcataatggcaccaacttatagttttttttttttttttwtttcttttgagtcaggatctcaccctgttgcccagactggagtgcagtggtgtgatcttggctcagcccttgggctcaaacgatccccccacctcagcctcctgagtagctaggactacagacatacaccaccatgcctggctaattttttttttttttggtgggttttgctatgtttcccaggctggtttctaactcctggactcaagtgatctgcctgcctcggcctcacaaagtgctgggactacaggcatgaactaccatgcccggccaaacttctaggtttcttaaaaaagtgcctggcaggccaggcgcggtggctcatgcctgtaatcccagcactttgggaggccgaggcgggcggatcatgaggtcaggagatcgagaccatcctggctaaaacggtgaaaccccgtctctactaaaaatacaaataattagctgggcgtagtggcgggcgcctgtagtaccagctacttgggaggctgaggcaggagaatggcgtgaacccaggaggcggagcttgcagtgagctgagatcatgccactgcactccagcctgggcgacagagygagactccatctcaaaaaaaaamccaaaaaaaacagtgcttgttgttcttttgttgttattgttaaaggatcattatctcattatcaacaacattggcaggtaattgagcaactgtttgtctccttgtcaatgtggagatagaaaattgcctacgaggttggacaaggtgctggagcagcgtcaaggaagagagatcgaacaagaagactgctttgcccttggacagctttgtttctgaagcactttctcatattctcccatttaatcatcccctccctgccaacttttccaacaggtgcatacttaggtagagctattctttatcagcctggggctaagatttgttcctgggcaggttatctttgtctctgcctggatagaggcaggggcagtagagttgtcatgcattccagactactagctatgcagaagcaggagcaaggtaagagcagatttgtatgaatgagggtgtcagggaatatcttagatgtccatttagttgttaaaaaagagaactgatgcctatatttcaaaacccaactttgatctggatgcagtggctcatgcctgtaatcccagcactttgggaggccgaggtgggtggatcacctgaggtcgggagtttgagaccagcctggccaatgtggtgaaaccttgtctctattaaaaatataaaaattagctgggcgtggtggcacacgtctgtaatcccagctacttgggaggctgaggcaggagaatcgcttgaatttgggaggtggaggttgcagtgagctgagattgcaccaatgcactccaggctgggcaacagagcaagactccatctcaaaaacaacaacaacaagaacaacaagaacaaaagaaaaaacccctaactttggagaggttatctcctgaaaaggagggttttggtctctttctcgcactgctctaaaatagtgactggcacatagtaggtagtcagtaaatatttgttgaatgaatgaatgaatgaaaggtaattggccttccctgctcagttctcattaaaaattctggttttcacatatatgggcagtgtcccaacaggctgctggggggtggccgtttgtgatggcctcaccagtctttcccagagagggaagtgcacatttttargctacttttgctctgactgatacacttggctgcctaacaaaaagccagagaagaactaagatttttagcatcattcaaaatgcttgccattccttttgctttgtgaaatcatgagctagttattttgagttcacataaaggtcagaacttgatctggggaaggaggttccccttggtttatgtgaggggaactttttcgcccttctgtttattttatccaaaggcttctgtttttctcccaagctaaaatctggcatttgttgtagaaagttctcagcttatgtgtgtgtgtgtgtgtgtgtgtgtgtttttaaaaagagctcatattttggctttagttttgattctcagtgattttttttttctgcctgagagttgattttctgcttcttcaaagtccagctctcaagtgggtgcctaaagttgtttcgttttagaggtgacttaatcattttttaggcctttaagtgctgctcccagcttgtgtttccttctgtttttagtttttatgtggggcagggtctccaaagtacacgggctcttttccccacccctctaccctcattttaactgtgcatcaaatgggtcctgtttcttcttcatgtataattttgtgagtcagggaaggtggtgaaggcccttgaaccctggctttgtcatggcccttccttaaggacctgaaggtctcttctcctaagggctaggttggttcagaaagtgagaagggctggaccttttgtggggagaggatacagcagggtccraacagctgggctgayaccgggcagcagcccagcagcagtcggagctgcagggtcagctcaccatgggctgaacttgggcattgcctgtttaggcagagtctgcccgagcctttcctgctccctgagaatcctcagcatgttttcctgctgagcaaggagtgaggaatgaagcccactacgaagcccgagctgcaaatktatttatttatttatttatttagagacagagtcttactctgtcgcccaggctagagtgcagtggtgagatctcagttcactgcaaccaccgcctcctgggttcaagcaattctcctgcctcagcctcctgagtagctgggattacaggcgcccaccacgggcccgagaactgagtctcgcccatctaatttttgtatttttagtagagacagggttttgccatgttggtcaggatggtctcgaactcctgacctcaggtgattcacccaccttgaccttccaaagtgctaggattacaggcgtgagccactgcgcccggctctgagctgcaaatttaatagggaaactgaaggaagaggttctccacagcaccagtggggctgagacctgttttcctcaactaccyttttttttttttttttttttttttttgagacagagcttcactcttgttgcccaggctggagtgcaatggtgcgatctcatcttactgcaacctcttcttcccaggttcaaacgattctcctgcctcagcctcccgagtagctgggactacaggcatgcaccaccatgcctggctaattttgtatttttagtggaaaagcggtttctccatgttggtcaggctggtctcgaactcccgacctcaggtgatctgcctgcctctgcctcccaaagtgatgggattacagatgtgagtcactgcgcctggccaactgctttggtttctgagtcctccctcctctaagcccgctcagtgtgtgtcattcctgggaggcggtggctctcccaggaccccatgccgaaatctgccttcttcttgtcttcattcccccacctggggtacccctcagtgttttcccattacacagattcacgtttacatgttctagaaacatctgtaagtctttttcctgtttgtaaattgtatatcctctgttagattaaaaaacttttaaaagtaagtgtctttctctgtggtgacctatttgtgtggcatagtataggttacaaagcccttttcatgcattgttttacttataagtaatgtttatagatgataccgaggtagaccctatggggtgcttactatgccaggtctgttctaagaatgttatacacattaccttactaacccaccccaaccatccattgtgttattgtcacccctgttacagggtggagagaagaaggcagagagaagtggaatgacactcctgaggctaggcatttgccaagtgaggtctgggatttgaacccaggcagctgaacttcagaatcctggtgtttaaccactataccatgctggccttmatgttattgagcaggataaggaattgtcactcttgacttgtttttgaaacatgaaaacccttctcttaaattcaaaagtaatacatagctgggcacggtggtgtgcacctgtagtcccagctacttaggaggctggggaagaggatagtttgagtccagaaatttgagactgcagtgagctctatagtcatgccactgcactctagcctgggtggcagagtgagaccctgtcaaaacaaagcaataacaaaaaaaaccaaagtaatgcgtattgcagcaagtacttaaataatgtagatgcataaaagcaaaaagtgagaatccccactcctcctccagtgctctgagatagactgaagtaactcttcagggatgagtgtaaacacaagggatgtcctcgaagactttccacttggaaagcttgtgtattttatacattaagtatcataaatatgtagttaccctaatgggtccccgccattgctctgcaggcagtgggctgaggttcaggagttaagtcagccccagggcacagggtggtgcaacagaagagcctgagtcgaatccagatctcccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaattctcctgcctcagcctcccaagtagctaggattacaggcttgagccactatgtccaactaatttttttatttgtagtagagatggtgtttcaccatgttggccaggctcatctggaactcctgacctcaggtgatccgcctgcctcggcctcccaaagtgctgggattacaggcgtgagccaccgcccccagccttccagtygtattcttgacaaatggttttccatgaagttgtggacaccttccagggtcacaattaaatggttaaatgagtcacgattaaataatgattgtgggtacctcccagagtttcaatgaaaaagggaattaactttggacacagacagaataatgcaaatcttcagttttggtttagaaaatctgaaacctgcagtggggaatacagaaaagaaggaagtagaaggagtctgtccccaaccccgccccttccttttttctctcctctggagagagaagggattaggaggcctcctggaaaggagtccctttcctgtgatcaaactcaccccttccctccaccagagcaattacagagcctccggcctggaaccttcctcaccggcctggaggagacaccattctgcggacaatggggggaaggaaaggaaagcaatgccgctgccaatggtgcggatgacttcctcaatgccagacttgcttgcactttcaaagtccctcctcggaggtcccctggtaggacctggagataggatgtgctttcactctttacagactattgtccaggaaagaaagtttcagactttcttaggcagggaagggccctctgactgtgaatttatttggaaatttgaaagagaagagagtcttatcctaggaagtgttctttttctttccccctggatttgacaggccaggcaacagcaattatccaaaccactgctctgcaccaagaggcaaaccacaggaaaaagaaacccgaacaagcaaggagaatagaagttccccaaagcatgccttcttgtttttctcagaggacagtcttttcattcatgttttacagattggtccaacaagtgcagttcttctagtytcctatctagataagcaggatattagaaggaataggagaggcctgcaaaaagctatgatagggtggaaataggataggagaaactgaaaaaaggggaggcgtgcgctccaacacctccatagcccttggggacgggcttagtttctaatgagaatacagaaggcccatgtctcaataggccccgaaaaatattaatccagcccaatatgaacagtctgctaattatatgactgggcctgcttaggagatcagggcaatattacattcagagtactcagtttaggaagatgacacagtgtaatacatacagatttccatcatttcttttattcctcatttggagaggcaacagggctgagatagacatgttagcgatggctagattgattgatttattgactgaatgaatggcctgctttaggcagcgggaacactgaatgaacattttaaaatcagctggtataggtcaggaactgtgcaggttgctgggaatgggtagatgaaaagacattgctatggtttggctgtgtccccacctaaatttcaccttgaattgtaatccccatgtttcaagggtgggaccaggtggagataattgaatkggggggtggtttctcccatactattctggtggtagtgaataagtctcacgagagctgatggttttataaatgggagttcccctgcacaagccctcttgcctgccaccatgtaagatgkgactttgcgcctccttccccttccaccrtgattgtgaggcctcgccagccatgtggaactgtgagtcaattaagcctctttcctttataaattacccagtctcaggtatgtcttcatttgcagcatgagaacagactaatacagacatggaccttggctgtagggagtttgcactgtagtgacggcaagagctcacgtgatccattttaagatagaagagcgagctcaggcagaggaacacagagccaggatggtccatgcacggaatctggccctgcccttactttctccaggagcatgggctgggtccctctcctccctaatcctcactttgctcatgtgtgaaatgtagatcaagtaagttctacactcagaggtctcttgtgaagattaaatgagaaaaggcatggaaactgcctttgcacacagcctggtatatcctgatgtctgctgatactcttatttttatgttccttgacattccaaatctgccccagggagaattccaggacagctctggagaggaagtgatctttgaatccaaccttgaaatcaccctaggagatgcaaagaaggtgacaccagttaagaataagatgtgtacccattttcaaatgttcttttttttttttttcagatggagtctcgctctgatgcctaggctggagtgcagtggggtgatctcggctaattgcaacctccgcctcccgggataaagcgattctcctgcctcagcctcccgagtagctgggattacaggcgcctgccaccatgcccagctaatttttgtgtttttagtagagatgggatttcaccatgttggccagactggtcttgaactcctgacctcaagaatccacctgccttggcctcccaaagtgctgagattacaggcatgaggcactgcacctggcccaaatcttctcagttctaaatggctgtgataaaaactacattgayaatttttttttttttttttttttggagatggagtctcgctctggtgcccaggctgaagtgcaatggcgcaatcttggctcactgcaagctccgcctcctgggttcacgccattctcctgcctcagcctcccgagtagatggggctacaggcgcctgccaccacccccggctaattttttttgtatttttagtagagacggggtttcaccatgttagccaggatggtcttgatctcctgacctcgtgatccgcccacctcagcctcccaaagtgctgggattacaggcctctgcgcctggccttgcatkgacaattaatttgtttatggaaagccagttatccaatgatggtgaacaaatgcaacttgactgtataatacttattttggttttggaccaaagtcaccattaaatatgccaagttcttgttcaaggaaacagctaatgtcgtggacttgcatctcatttgtagttggttctccctgaaaagtcagtggtgtgggagaaatgatacttagtcaaaatcatcagtgaaaatcattgcttggatcatcccaaaatataatgaacaaaagtgatatttatctgccacattgagaaacattcaccatatctcaataagctctcctcagccagttggtccttttgtggttgaaaaaagtgccatatctttggttgggcatccaataaaatayggtatttaggggctacctgtatggaaaatccatatccttaaaggttagctcaccaggaggatgttgagaaatggcacagggggctgggcgcggtggctcatgcctgtaatcccagcattttggggaggctgaggtgggtggatcacttgaggtcacgagttcgagaccagcctggccaacatggtgaaagcccatgtctactaaaaatataaaaattagccaggtgtggtggtgggcgcytgtaatcccagctactagggaggctgggcaggagaactgctggaacscaggaggcggaggttgcagtgagctgagattgcaccactgcattccagcctgggtgacaggcaagactctgtctccaaaaaaaaaaaaaaaaaaaggcacacaggaattgggttgggactcagtagatcagtagatttagatctcccagcttagtctcatctccatagtgtgggtggagtagtactcacactatttaaattatttttatttcactacctgaatcccctcagcaagtatagtttaattcacctgagtaatacgcttatgcgaggggatttctccatgggccttttgtttttgctcctgctggtgatctgattttaaatgtgaacgtgccattgctaagagtttttgttctatgtattattctgtgtggaaaatttcttaaatgggattattgaagtatacttcattatttatcttctggcaatttatcaacaacagcaaatatcattcattattgtttggaggacagaactatttttatattctttaattaaaaatggctttgacattttcaaattcagagggaagttgataatttagtgctgtatgataggacctttagttggtctgaatgtcacataattgtacaaattgctgttaaagtatattattacttattttctgagaggtagagggacttggttatcctgggattgcataattattggttcactagaactacagatgagtgaaaagaagggttagatactctctagttcacttttcttccagtgcagggaacattctatggggttccgaacagatataataagctcataataacagtggccattgattgaactctttctatcaaacaatgtgaaaaacattagtagaggtgatatcttagtctgcttttgctgctgtaacagaatacctgagactgagtaattttttttttttgagatggagtctcactcttctgcccaggctggagtgcagtggcgctatcttggctcactgcaccctccgcctcccgggttcacgccattctcctgtgtcagcctcccgagtagctgggactacaggctcctgccaccacgcccggctaattttttgtatttttagtagagacggggtttcaccgtgttagccaggatggtctcgacctcgtgatcctcccgcctyggcctcccaaagtgctgggattacaggtgtgagccaccgcacccagcctttttttttttttttttttttgagatggagtctcgctctgttgtgcaggctggagtgcagtggcgccatcttggctcactgcaacctccacctcccgggttcaagcaattctcctgcctcagcctctccagtagctgggactacagatgcatcacgcccagctaatttttgtattttcagtagagacggggtttcaccatgttgtccaggatggtctcgatctcttgacctcakgatctacctgcctcagcctcccaaagtgctgggattacaggtgtgagctaccaygcctggccattttttttttttttttttttttgagacagagtctcactctgtcacccaggctggagtgcagtggcatgatcttggctcactgcaacctccgtctcccgggttcaagcggttcttctgcttcagccttttgagtacttgggattacaggcacctgccatcatgcctggctaatttttgtatttttgtacagacggggtttcaccatgttggccaggctggtcttgagctcctgacctcaggtgatccactcacctcatcctcccaaactgctgggattacaggtgtaagccactgtgcccagccccaagactgagtaaggggtgagcagaaattcactggttcacagttctggaggctgggaagtctcgtatcaaggtgccagcatctggccagggccttcttgctgtgctatcccatggcagaagtacagaagggcaaagaaagagggctgaacttgcccttttataatggcaccaaccccacccatgagggtggagtcctaatggcctaatcagctctctgagatcccatctgttaatactgttacaatggcaaytaaatttcaacatgagttttggaggggacagacattcaaaccatggcaggtggcaagaagtatcaaactactagatccttgggattgtgctttgtactggggtgtattttttccaacaatcctaaaaatcatttgaatagagatagcaatatatatcttacccatttggaaatgcacagagattcaggagtgttcacatagaaacagaagatcattggcttttgtccattcccaacgccagtgatctgtttttcttgactctttttgatctgtgtttctgaatgtgttgatatactgcgctactggtgtgcaggatgattttaaatgttgcacagatgaacattaatagtcatctattttaatatgtattaggaaaaagcccataaaacaatgaagcccattaaaaccccatggtttcttggatagtattacatagggtgaagctaattttatttcagtaaaaaatatgcaggtcaatttaaataaaaaaatagataatagtataaatgkcttgtggctacagtaaaaatgatgatggtacttgaatgtccaaattaatttaagtgatatatgtgttcatagataccatttcattttaacgtggttctgctggtcagaacagtcttacgatgggggtggtctccaggcttcaccttgtgcccactggctctgtttggttcctctgggctcacacacagggagctacgtatgtctctctcatttcctttggtatgttctctgggttaaatgtccccagctrtctgatctgttccctgcgggccttggccattcctgtcctggcctttactggcagtctctattctaaaatgtgggcatcccacatgaggtccagcttctcctgagatcccyggaggtgcagctgctgtgatggtgaccttgtttagcagatgctccctgcagtccaaactcccacccatcgtcctgccctttgatccatttcccatgaactgcttacctcagttttctcatctgtaagatggagagataactgtaagtgcttagcacagtgtttactagcacagactactgctattactgtcaagtcacttttcctttgctgccaataggtcattttctgtttatggcttcttcagtatgaactgatcaactgtaacttgaaaatttccagacttaggacttttggactcatagtgaaaggatcctttcccaattcccttgatcggtttttcctttaaaaaaaaaaaagatatttgacatcttttcactttcaagttcagtttctcttctcctttttttctgggtgatggtttattatttaaaaaatttctatgtatatgtgatttaaaagtaaacccacgtagctgaaaatgtctcataggtttttcttgcattttcagttgacccattcactttgcaaatctttagagtattatatttaagacagcttgcagctgttttcttatatatattttacatgacaaaattatatttaaaacatattaaactttaaaaaaccatagtttataatttataagccatgtagcatatttctrtttttgagacaggatcttactctgtcacccaggctggagtgcagtggctcgatcatggctcactgcagccttgacctcctgggctcaagtaatcctcctgcctcagcctcccaagtagttgggactacaggcacatgccaccatgcccagctaatttttatattttttgtagagatggggtttcaccacgttgctcaggctgtaatttttaaaaactaaaaaaagaaaaaaaagtgtttacaggactttaaattgagaaacttaaatatctttacatattctgtgttcctaatttatttttgcagcagtaattatttcagctgtctttagtattgacatgttggaacctcggattaatttgtgcatggatatatttagagccttttacttgacaagaatcatgtatatcatgactgaatttgtaatttcccagcatgagacccaaattaatagacagtatttagattctaggcaacgatgcattatataaaccagcatcatttagggagtggcaaagactctctccccaccagttctgtgaacttgggcaaggtgtgtaatctttctgagccttaatctaattagaccctttctcctgtaacccagagggggtgttagtaaagttggtgtgaaaaaagtcaattattgtactgatgcaatttgggtgaaactgtgaagttcagtgttcacatgatggttgtggagacactgaaccttaatccttaggccagggattcaaagttttttttgactctcatgttgaacgttgtctaaagtgcagtgtgccctagtttttaggtaattctgagaattctaaggcccttgctggaataattaatgagaatatgagatttcagcaaattagggccaggagtcagtgctctcagcatggaagaatctcacctccaaaaattttatgtgggttttacacattaagcaagcataggtgaggtgcagtgaaggggaagtgatggctgtcagtcgtttggccaggttcctttgcatacaggggagctagtgggtgtataccagctgagacagctgaaggaggagaacatgaagaatagttggaaactattgaacctccaagatttttctgtctttgttaacaactagcagttacatgctagcattatttatttatttakttagttagttagttagttcttgagatggagtctcactctgtcacccacgctggagtgcagtggcatgatctcagctcactrcaacctctgcctcctgggttcaggtgattttcctgcytcagcctcctgagtagctgggattacaggggcccgctaccacgcmcagctaatttttgtattttgagcatgttggccaggctggtcttgaactcctgaccttgtgatccccctgcctcggcctcccaragtgctgggattacaggtgtgagccactgtgcctggccttatttatttatttttgagacagggtctcactctatcacccaggctggagtgcagtggtgcagtcatagctcactgcagcttggaactcttgggctgaagtgattcttcttccttagcctccccagtagctaggactatagtgccaccatgcctggctaatttaaattttttttktgtgtgtgtgtgtggtggagatgggttctcactgtgttgctcaggctggtcttgaactcttgggcttaagcgatcttcccatcttggcctcccagagtgctgcgattacaggcgtgggccaccacacctgtcctgtgctaggctcttaacgtccttcccagatgttatgtcccttcccttggtggctgctgctttctgccacattttaccttgcckttccgcaccttctaccatgtctccttttccagcctcattccctgagatgtagccggagttccagttcagccaacctgcccgttgttttctctcctggarctgggtgtttgagyctcctgcatggagtgttcttccttcccagctaaagtcctggtcatcccatttccatctgaaaggcccccttgttcatgaagcctctcatggtccttccccctaccccagccaggtatactttctctcctcttggaattaycctataggaagaacatggtggcttgacctgggttccagtctcacccatctgtttacctggggagtgatcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgtcttaccttgttttaataaattataatcttatgggagatgacactgtcttttctttgtttcrtatataaaaagtgttttgctgatatacgtagaatcaagttggtctggagttactctggataagggatgaaatcagggagctcttgtgttcaaaggggccttcttcccttttttggttctttctcctcattttttagcttccatttttacttcctttagtattgagaaagtaccaggctcacttcaaagagttgacttcaaagctcccaccagctcagamatacttgcsactgaagcctgtaggaattggcatcaatggaagaccctgtggcggttgcatttaagattttttttgggacttctatttttataattcttttaaatggtaaaggrggagggttacaaaatatctgcgcctttaagatatcaaacataagccagtgaagttccaaaaaaaaaaaaaaagatgtcttagagaaatgaaaaggattttacaattggtagaaaagaacaactcttttttctttttctttttctttttttgtttttgagatggagtttcgctcttgttgtacaggctggagtgcaatggcgccatctcagctcacygcaacctccacctccccagttcaagtgattctcctgcctcagcctcccgagtagctgggattacaggcacgggccactatgcccggctaattttgtattttagtagagacggggtttctccatgttggtcaggctggtcttgaactcccgacctcaggtgatccacctggcttggcctcccaaagtggtaggattataggcatgaaccactgtgcctggccaagtcttttttctttaaaaaaaaaaaggttacttttactgttttgtcctagttacaagatcttaggacagaaataaagccttaacttgtatgtaacattttccaagatggctaagtggagttgcaggttacatagcagaaaacagaggcttgggcctgttgagacctcacacccagttcttcttggagctgtgggtgtgggctgaaagagaagacagggagattaaagaccagtgatttccctccatggaccctttgatgctcttgtttgttgactttttgaggcttggagtgaccgactcttccaggaatgagaaatggaatccctcccagttttgatggtcgtcccaggacatatttcctgaaggcctactctgtgtctcagcaccattccaggactccccccgacagccttacggagcgtgctacagtcttcctgatccaatatcctgccacctgcccactcattcaccctcggccctaccccatgcctttgcacgaatctttccagcctgagcagcctgagatgggtctttttccctgctccgaaatcctgacctcataatggctcatgaatccctattcaaccttcaagacctggttcaagggttaaatcctttaaggagacttctcctgatttttccccagctggttgctttgttctccagcgatttgtaaccttgtgaacaaatattctactcattttattctactggaatgatctatttacacttatctccctgcaaattgtatcctgcccttcaatggctaagtgaatggcataaacagatgctataggaattgagactaagttggagctgggtgatcagggaaggttttaaggaagagatctgggacaaatagctaaagatggattcagtgttttttttttctttttctttttttttttttgaggcggagtcttgctctgtttcccaggctggagtgcaatggtgcgatctyggctcactgcaacctctgccgcccagattcaagcaattttcctgcctcagcctcccaggtagctgggatgacaggagcccaccaccacgcttggctaattttgtgtttttagtagagacaggttttcaccatgttggccaggctggtcttgaactcctgacctcrggtgatccacccaccatggcctcccaaagggctgagattacaggcatgagccaccgtgcccggcctgatggattcagtttatgtgcaaaatttaagaggatgggtttcggcagttcaggttgttaggagacaagggtggaaaggtgtcctggagccctacagagatgggcttcaagtgccagccaaggtgtttgaccatttttagaagaggaatgagatgattaaagtggaacttttaggaagagtaggagtgagcgggatggatttaaaaggcggagtgagaggcatcaggaaggctgggtaggagagcattgctacagtctaggagggaggtggcaggggtgtagaccagggatcacaaagcaatggcttgccatctgcttctgtatacccagagagctaagaatggtttgtrccttattaaatggttgaaaaaatcaaaagaatatatgctgtgatatgtggaaattctgtgaaattcaaatgtcagtgtctgtaaatagttttttttttttttttttttttttgtggaacacagccatacttttcatttatgcattgtttgtggttgctttcacacaatcatgccagccctgagtagttgctgcagagaccatatggcctgcaaagactaaaatatgtacttatgtactatctggctctttccagaaaaaatcagcagaccccaggtgtagaccaaccagggtgaatgagtgtatgactggaaatgcaaagacgggcaggatcaagggacagtttagagcaggggtgtccaatcttttggtttccytgggccacactggaagaagaattgtcttgggccccacataaaatacaccaacactaacaatagctgatgagctaaaaaaaaaaaaatcacaaaaaatctcaaaatgttttaagaaagtttatgaatttgtgttggtctgcattcaaagccatggtgggctgcatgcgggccatgggttggccaagcttggtttagaggcggaygcagtacgggagagttttcccttctcttctgatgtaactccatgtcttggtggcggtgttctagatgtaggcatctttaggcaggggagtgtgcgtggaagggtgaaagggttgtgccttcatgacgctcgtgtgtgtgtgtgtgtttgtgtgtgtgagtgatgctgagctagtcttagagtaaatgcagacactggatggtagcgagttcagtgcagtttttatggagggacagcttgctgcctgctgatgaagcyggacaagactgggtagtgaagtcaaaggcccacacctaactctgaggctcttgggggcaactgtgttgtgcagagaaggtaggagggcagaggaagaggaggagcggcccctgggagaatgccttctacccagctgcagcttctcaagggtgtgtttgcgtctgacctaaggtgttggagctctttgtttctggctgtgttcaggctttcccccgcttgcctttaggggaagctgatgactgctttagcgtaaagagagggccaggaggtcaacttccctacagtcccgtgcctgcttctgggttggggctggkgagagtgctgcccactgaactctctaaatgttaaaagatacaaagaggaagcacagagtgaaaagggagaccccagaggacagcagaacatcccgaagcatatcccccatcagagaagaggcatgattttcacctggcttgcaggtgcaggatgggcatctcagatgctgtgagtctgagggcagatgcccatcagtccaggacagttcctggggacaaaagcctcttctcacctttagagaaattaagtcwtattggtagaaaatattttagagaggttctggtctaagcctctcattttgcagatgagaaacyacccaaggcccaagatggatggatttatcaaagccggttggtrctggaacttggatttaatttcaggtcttttattattactatggaacaaatcttaactttttcaagtgcataccatgtgcccggctatgtgctggatgtagatgctttatctgcaggtttaatcttcactacaactatgggaagtagctattgtctctcttttgcaagtgtgaagagtgaggcttagaaaggccaacttgcctgtgatcgggtaactcaagagggaaattggatcagagtccatctgagactgactccagagccaatgttcttagccaataggggcacataaaactgttctgagtggcttcctagctcctgtttccagtgtccaatccattctcggtttctgttcattcatcagatgtgcactgagtacctgcaagaagtcagaagggtgttgggttggtgaggacagattgtataccatcttggctttggccgagccaaacagaatgccaaagatcggcaaagatagggaatgattgttcttggcctcagctccacgctcccctcctctgtaaaactgcccctgacaccccggcaggattgaattcctccacctttaagctcccagagtacctyagctctgtctttagcacttcacactgtgtcatgcctccccttgggccctaaggccaagagcatgtgccatttatttttgtattcctacttctatagcccagtgcatattgggggcactcaggaattgytgagcgaataaaagaatgaatgaatacagacccagattgtcaatgattctcaaaccttattttacaaaagaatcacttgaaaagctggttaaagatcaaaactcctgagccctactcctggtgattgactcctaggtttggggtgggaccccagaatctgaatttcccggaagcgcccaggtgtttctgatgcgggtggtctgcaaaccacacttgcagcaaccctggcacaggtgcccagccttctggaataaagacaggaactaagcattaaaaatagcacgccattcatttgcttgtgccgagccgccaagtgccccctcctgcyggcgacaggtccggatgtgggccagttctcagcccagggaaaatgaacagtgtcttctccrtggtgcccagaacagtctgagtcagtggaatgtgctggccagtcaggcagaagggaacttccacttcttttttaaaaccttggtggaaactgtgctggcaaggcaaacagggaggagaggaagctccatgtggggcttgggcttggcggacgacttggggctggccggactttgggtggccgccgaggaccattgctaaatatgcccctttcgtcctgaaatagtcacttccccggctggcttttgtgttggtcggtcgccacaaatgtgtggctgttgttcaaggaggcctcctgggatataaaaagagagaatggggccaggctgcggccagggctgtgtaggaagacaggagagctgccttttctcctgtcccaccacggactcattgtaagattcagagggagtggcttctgggccctgggtttacttttccatctgtaaaatgggtggggggaaggggcagcatcataaagcttctttcttctcctgaaagggatgttttaaggcccatgtcaagattgaacacagggctctgttgttgggctgatgctactgatgaagtctcaggaagctcgaagtttgtagttaactctttcagggtagatgtggtgaatagtctcttggtattgtgttgatggtggcccactagaacagaaggtcccagagggcaagggcttggtctttcttcttcctctctgtatccccactgtttagaactgggctgggtgcagagtagtctccataaatgtttatggggccaatatctccaaatattggcacctactaagcgtcagtcccatctctcttttgtcttcttcacaggtttaacttgctgtttgagaagaggcgatatgaggagcagggcatttttggaggaagaaactttacctctgttttcaacgtttcatccagtttctcttctttttacttatttggagacatggtcttactttgttgtccaggctggaggctgaagtgcagtggcacaattatagctcactgcagcctcaaaacacctggcctcaagtgatcctcctgctttagcctcctgagtagctgggaccacaggcttacaccaccatacctggcaaattttttttttttttttttttggagaggcagaktcttgctccgttgtccaggctggagtgcagtggtgtagtcatggctcgctgcagcctctgtctcctgggcttaagccattctcctgcctcaccctttgagcctccttaattttttatttatttattttttttttgtagagacagggtctcattatgttgtccagcctgatatkgctatttttttttttttaatggcgatgtagtaatcttgctttgttgcccaggctgttctggaactcctggcttcaggtgtgtgccactgtgcctggcccagttgctctttacatggkggaatatcagaggttaaagacttggtaaaaattcatgcggtgcaataaaccatgtattacataataggggtgacacttgttaacttctcccaggctcagtttcctcatgtgtaaaataggtgaatagtatctaccctccaggagttgtacaaggctcatgtatacatagtgtatgtgaatgtgctgtatgggtgcaaggggttgcagaagtgataatgtgtgtaaacagatggtgtggttggctcattggaggggtggaggccctaagtgrgatgacctctgaggtttactcttcctagagtagttggaaagcaattcagcctcagtggtaagctctcagctcttctagggcaggtccctcttccaccaccctgtgtctgcaagcattttggtattaagttgtttttctaaggctgggtgcggtggctcacgcctgtaatcccagcacttttggaggccgaggtgggtggatcacctgagatcaggagttcgagaccagcctgaccaacatggtgaaaccatatctctactaaaaataaaaaattagctgagcgtggtggtgtgcgcctgtaatcccagccagctacttgggaggctgaggctggagaatcgcttgaacccgggaggcgaaggttgcagtgagctgacatcatgtcattgcactccagcctgggcaacaagagtgaaactctgtctcaaataaaaaatattatttttctaaaaagctcttattttattgtgaaacacttaaattagcaaatctcaggcttgctgaataaggcttcccaggcaaaccacatcccacatgtgcaaatgtctggtgacacagtgcttcatttttttccactagtacttactactacctgacattatagtgtaagtttacttgtctatttgtgtatggtctgcctctcctatgagaatgtgagctgcatgaggtcaggacattgttttgttcactcatgaattcccagcacccaggacagtgtctggcatgtagtgagtacccagtaaatatttgtggaatgaatgaatgaatacttaagtgggtgggaagttcttggaccttagtctagacccatggttctcaaagagtggtcctgggactcttggggattcctgagatccttttagggatctgtgaggtctgtgaggtcaaagtatttttataataatagtaaactatttgtcctttcactctcattccctcatgtatgcaaatctcagtgaactgatattttccaaataaccaatgcataaggccacaaagccatgcagggtaaaaagagctatgaacaaaagttttctagagaagaatttggaggaaagagagtttattctagtgaacagatcgcaaactgggagatgctgcgttggtgtaaaatgaaggtgcattccagagagcaaagagagaatctagttttttgttgttgttgttgttttgttttttaaattttgagatggagtcttgctctgtttcccaggctggagtgcagtggagtggcgtgatcttggcttattgcaacctctgcctccgggttcaagcgattctcctgcttcagcatcccgagtagctgggactacaggcacttgccaccacgcccacacaccctactaatttttgtatttttagcagagacggggttttaccatgctggccaggcttgtctcgaactcctgacctcaagtgatctacccgcctcagcctcccaaagtgctgggattacaggcatggcagaatctaggtttttatagcaaaatttctggcccatgtccccaatcaggtttgattatgcaaatgaagggggcgggtcaaacttgcttagttctgattggctgacacagctgagttctgattggtgatacagctgagccctgattggttgatacagctgagctctgattggctgaagcagacgagctctgactgcttggttcatgtgagctctgaaagtcccaagtcaaaagggtgtggggttttgkgaaactyggagtacgtagtgtgacctctagtcagcaaatggccacttggctgtattttaaatttaggtacactttgctgcttggggtccatcttgaggggattgcctttttyaggttcatgtttgttcacagagccattcaaagtgcagtggatacattataaattgtacaattatttgtaattaaaaaaagaacaacagcaaaaaacccaaagtgcartggatgcaaagaccaatggattttcatgtaacagaatatgaaaagttcaccgacacagtttcacattccacgatgcagagaagtttttaataactgccatccacatgttgagttttggtgtaacagcaaagaaaaatatccacaactactgaaaaggctgagaaaatactccctttctcaactgcatgtttttgtgtgagtccagaatttctttacattattgtaacagagtgaacgcagaagcaaatatgagaatccagctgtttcttactaagsagacattaaagagatttgcaaatatctaaaataatgctatctctctcacttttttttttttgtattggaaacatcattttccatacaatgtcatttatgttaacaggtgacagatttatttatttttattttttatttttttgaaacggagtttcactgtgtcacccagccacccaggctggagtgcaatggtacaatcttggctcactgcaacctccgcctcccgggttcaaaggattctcctgcctcagcctcctgagtagctgggattacaggcacccgccaccacacttggctaatttttgtatttttagtagagacggggtttcaccatgttggccaggctggtctcgaactcctgacctcaggtgatccacccgtctcagcctcccaaagtgctgggattgcgggctgggattgcgggcatgagccaccatgcycaacaacagatttattataagcaaaagctctttggggtcctcaataattttaagagcataaaggagaccaaaaagtttaagatgtgctggtcaagacagagccctgtggactatggaagggattgaagccattctgtggatcctataggcttcttttctaagcgaatgattagtgtttattcagtarccctatgtcaggtggtttctgtatgaatgagaggtttgcctttccagctgcggcggggctttgggcaagttgctgtctctgtgctccttcgtttgctcatgtgttaaaaactggcccaggggtctgggggtggggtggtaagaaaatgggttgagtctccttcatctctaacattttcatgtttaattcttggaacctccacttgttagctctgttcactcctctgaaagagattggtgagaattgaaacagtgaaagaagattttagagaaaaggtgacatgtaaagctgaacaagggttgcctgtgaggcaggcaaaaaggacatttattatatttaaaaaaaattttttttttgagacggagtctctgtcgcccaggctggagtgcagtggcatgatctcggctcattgcaacctctgcctcccggttcagcgattctcctgcctcagcttcccgagtagctgggattataggcacacaccaccatgcctggttgatttttgtagttttagtagagacggggtttcaccatgttgaccaggctggtctggaactcctggcctcaggtgatccactcgcttcggcctcccaaagtgttgggattacaggcgtgagccaccgtgcccagcccagaaaggacatttatatgtggggaccactgcatcttgcagatgggtaaactgaggtagcgacaggtgaaggctcagttacattcatcctgggtcccagactgtctccaacctgtagcctgaagctttgtttccttcctccctagcccaggatgacagcagtgaccttccatgggatcttttcctgggatttattgagccactgaggtcattggcctcaggccacctgcgtctctcgactgaccagttattcttcaaggaagacactgtgtgtgtgtgtgttttagttgctcttctataacttccgggtgctcttctcagagcagcagtgctttaaaaaatgtctgtgtgtgtatttccccactttgagccatgaaatatgttcagtctgttttttttctagtccaaagtatttccatatcattgtgcacctgaggaaatgcatactttgatagaaaatggacaaaaaagttgtattggtagaattaaatgaactaatgcatgtcaagcactgagcactttgactcaatagtamtaataataataataacacaatgtatcattatgatagtgttatatctctttagcaatcttgatagttgacttgtataattcacagtacagaagcttattctaaaactaaaatgctttggttctcctgtgtgccaggaacagcagtaaactttatgtcctaagattagtatggttggaaatgcatgtggcagtggttcccaaacactggtgtgyagatggaacacagcccgtgaagttttcagcggtccttgttaaaaagagataaaggaaagagataaaggataaagtgctgagattctcgtgaagctaaatgaagctaaataaacatccttcaatgagaatatgtccttcctatagtttttggaggaaaatatttccttttgtgagacaaaagtgttagtaggtggtaagtactttttatttagcatagtacaaagttgtggccctctgtcaacccttcacattttggtgtgtgtaatgtttgaaactgcattggtctgtaaaatcccaaacccaggtagataaaaccaagaagtgacagggctggaagggatcttaggaattagttcataaagaacttcaggctcagagaagrcatgtgagttgcctaaggtcacacagcaaatctgaagcaaatcagggctagaaacccatagacgatggtcatgagcactggttttgagtcatccatttgaacacacctgtgttcagattctacctctgttacttatgagctgatttcttacctgtgaaagtgggatacctacccaaggggttcacgggaggatttaataagatgatttggattaggaaaaactgacaaatttccccttccttcttctccctgccttcccctcacctgttaataaatagatccttgtgaaaggtcagtgagcagcatcagccagaagggctttgttttcagcaaggtccctgcatgtatgattacaatcctaagtaatatcagctgttgcttgcgttggtttctcagctctctcttggtgatctctctctttagctgttgaatgagttcaaagatctrggaagagctttgaaacccctctagcagcatttctgtctccagtcccagcacaggtctttggaggatgagataaaaagggttttgcccagggtcaaatgctgtgtacacgcttggtcactcttccctttcttgagatgacatgtccccttcttggagacccaagatgattgacaacaataacattcctttacaacrttttcttctcatctagagcactgggaggctgccttttaacagagatatcacagagtagcaagcatgcagacattctcatgacatcctggcagatatcaagaccaaagaacatcccatgttccctcttgaaggcttgtaataactgccataaattrtcttgtgggaatggagtggccctggcctaagctgtgctgtaccggactctcctggtgacagttttagtggctgcatatgtttgcagaagaaggaagcgtggtaacttggcaaacagctccaaacgctcctggcttgctgccacaggattgtccttgagacttgggcacagtgatgtgtgaaaaatgcccacctttgctcttggtgtccagtgggccttctatgggccctctatagaggtcatcacctggggattcctgactctggccaggtcctgaggtctttccatgttactctccatgttacttgagtaacataagagcttcttatggctcttatgttctgcaggacggatgaactaggtacccaggacaggtctgtttgtgcacaaggctgtctccttctccccctccttggtttytctactgaggctttgttgtgcttggctcagggtgatgttagcaaatgcactctccaccctgctgtgccacattaaggaaacgcatgttgtattggcttctgccaagtcagctcacatgctttgttttagtgactctgtgaagagctcatcatctattatttattcaggtaacacacttctatctcctaatttcggtgctactcccatttttcatccccggttagcgtgctgtgcggccaggagggctgcctgttgtctttaagaaccactttgaacatttttgctttggttatttattcataccaacatgttgttgttaaatgacgtgaaataaaaccccattttaaaaagaaattgtaaaaggaagctatgtcctgtgtggaaatcatgacaagcccagaaacatgttacaaaaacattaaccaggagcggtggctcacgcctataatcccagaactttgggaggccaaggtgggcagatcacttgagaccaagagtttgagactagcccggggaacatggtgaagcccatctcaactaaaaatacgaaaactatccaggcataatggtgcaggcctgtgattccagctactcaggaggctgaggcaggaaaattgcttgaacccgggaggcagaggttacagtgagccgatattgtgccactgtactctagcctgggcaacggagcgagactccatctcaaaaaaaaaaaaaaaacaaaaaaamcccacacacaacaaaaaataaatattgcctgtacctatcacctgaggagcccattgttaatggttgkgtgtctttttagtcttttaaaaaatgtgttaaaaaatgtagttgtcataatgtccgtatataaatttttaagtggagttgatagatttcatttgaagggctgctgtgtcataaatgtaaaatgcttagcaaggtgcttggcacctggagctgttcacagtaaatggaaggaatttttatggagggtgtaaggtagagtgggctcctgagccagactgccctgttccaggcctggctctgctatatctggctgctagagcctcgagccagccattgaagtgcagtgccttcatttccccacctgtaaaatgggggtaattatcatataccccaaagtgctgtcataaggatttaatgaaatatcccatgtaagatccttagagcactgctgccggatggtcatctcatagtaggtattggttgttattattcaggaaaatgttggaaaacacatttttaaacaaagctggtgttcagtcccctccctccccccaaccaaggaaactctctttaattcccagtctgctgtgattcagtgctggcctgggagcagccctcgagggcagacacagcacttgtcccctacccagcacagcacctgcctgtgcatccttagctgatgaatgaggctcacagccccaggcgccctgcatccttcccttctttctggtaccctcttttgtctcctccaaacacttgctactcaggcttcagggaggaagtaggaagtaggaggtggtttctccctcccagacccccagctcacactggtcttgaagggcgtggcatctgacagagcccggtggctggttttcacgtgtctcctgaagccacccctaaggagaaggcttcgatgtcatcttctggtcagagccgagcacagtggtcctcttcagagacagatccrtgcagcaggatggcacctctgttgtcctcccagactagcagtaggtacacgtgggcttcgcaggctgttttctgccctggaatgctgctgttttttagacccagcatacctcagtgtcagagaaggctggtttgtttgaaacggtcagaatgtcataaataccttatgat[450 bp omitted]cgaggaggaaggcggggcaatgttaggagcctctgtgccttggagctgcaggcgagttgtctggtcttgggtgattcccttcctatgtttgcatctcaattttccctcttgtaaaatggagctgagagcatcccttatatcacaggaatgtcattaggattacttaaggtgttggaatgtttcctggcctagrggaagagctcagtagaagcttgctattgccctaatatcattacyatcccagatatgcattttcttgttatttccctgttaggcgttaagtgtgtgaaagtgtgtgtgtatatttaaaaggtcaaagtaaaattctttagaaccttagggcaggatagctcttgtttagttaggggtgtttggtgactgctggagaagtcacctacccagctgatcttacaattactgtctgcttaaaggcagctcttgacttggccttctctaggggaaaaacatgtagtttatgcaacttttcttttccctttctgctctggatttgaccttttgttccttcaggtgattgaaaaaattcgraaagtcacctgtttcctcagaattgctttaagacaagactaagtgaaccaacaagaatgaagtcagctttttggaaatacctcccaagaggccttgctctttatgcaggactgttatttcaaaggatggtgtcccctccccaaccataagaacgatccaaacctgttttctggggcccagagtttgctgaggataggmctgggctgaagctttcattgctggtctgtggggtagaggtaagcctcccctgtgaagctggtaggttacatgctttggcaacatgaattgttatttctggagtcccctgggtgctgtttagaaatgcaggtaggtggctgggtgcggtggctcatgcctgtaatcccagcattttgggaggccaaggcaggcagattacttgagctcaggagttcgagaccagcctgggcaatatagtgaaaccccaactctacaaaaatacaaaaattagccagggatggtggtgcatgcctgtaatcccagctactcagtaggctgaggcaaaagaattgcttgaacctgggaggcgggggttgcagtgagccgacatcgcgccactgcactccagcctgggccacagagcaagatttcatctcaaaaaaaaaaaaaaaaaaaaaaagaaaaagaawaaaagaaatgcaggtaggtgcttctagctactgctgtgggatagcaaggtagttaccaaactgataagggtagcatcttacttactgctgaaaaattcagtgtcttttttctttttttttgagacagagtcttgctctgttgcccaggctggagtgcagtggygagatcttggctcactgcaacttctgcytcttgggctcaagatattctcttgcttcagcctcccaaggagctgggattataggcactcgctaccacaccyggctaatttttgtatttttagtagagacagggtttcaccatgttggctaggctggtctcaaactcctgacctcaggtgatccacccacctcagcctcccaaagtgctgggattacaggcgtgaactactgcgccgggcttgagtttgactttttgaaaatattccacctataagtgaagttgtgcagtgtttgtctttatgtgtttagcatatttcactcagcataatgtcctccaggctctgatgggcacttggcttgtttccatgtcttggctattgtgaatagtgccgcaatgaacatgggcaaattgccgtgttgagttaaggaagctcttttccastctgagtttgcaaatagcttttcatatatgagcgttgaatattatcaaatgcttttctgcattcactgagatgactttatgtatttaaaaaaatctgatggcctatattttctatttctaaactactcgtgtattcctggtataaatcaactcagtgtgttactctcgtttttatacatagctggattcgttttcactaatattttgtttgagatttttgcctcagtgatcatgtatgtgattgctctgtaacttttcattcacattttgtccttgtctgtcctggtatcaaagttatattggcttcatagaatgagggaaatgtttatccttctaaaaatatttagtagagtggtctaagatgagagtgtaagtgagtaaactttctcaatcaaatattttgtgatatgtttcaggaatttcattacatgtttggttcaatttttaaagcatttctttttattatttaaaacttttagcattggtgaccatccatgtgctgcttttattgccagcttaacttgtttttatgacatcttcaggaagaaaacctctgctgtctatttaatggagatgaattgttaaacttttaccatttgcaactayacgtctctatgagtcagacttttattgatcgtgtacaactaaatgaaacccggaaatgaaggaaatgtaacaagcgattttatgtattttttgtttgctcaaattgcctttataaaatagattgatactctataataagcaaatgttgtgaatttggaattttcaaattgaggcttactaataatgttawctattttatccgagtttatttgggtttcttataaaatgtaatttctcaagaagattttgctgccctaaaaaaaaaaaaaagaaaaagaaaaagacaaaaagggaagccactggttgctaatggctcctgcggctctgaygatcctcgatgaagtgttctttgattaagtgtcaagatgagtggtgcagacctttgacagacacatgattgtggttggagaaagcccagcattaactgctgaccttgccatctgtgagcaggtgttgaatgagctcagttccctcccagcccttctttttccctggtgggtcattggctcctgagtargatagatgcatgcaatagaagagctgttaatagcatttactctttcttaatccttattaatcccattcatatttcagtgtctgaaacttggcaggatgtcaagaagccacagtgcaagtagggaaattgaacagcaaggaccaagtacaatgttcccctgatatttaatttgctaaaacatgtaagaagaagaaagttcttacattgttaggtcccaaagagagtgccacyaagcaaccttgccaaaaccaccttgctggagcttcttattatctttttttagcgaatggcaataaagtcattttgtcaagctaaccaagtaccataatgagatctttgtggcataaattaaccgagtggggaaataactttgacaggggttgatgtccgaaatgaagtgttgtttgtctgatgtcaagcctgtggggaatttgaaccttgcactctttcctgataagacattaacctctgcatgggcttgctggcccaaccttttgattaactggacctattttcttgtagatctaatacaagsatttggagaaccccagtaaaatgctggagggacttagactctgatctctattgggatgtgtcaaattggagatttggtgggcttttctgcygtgtttactgcgatgggtgtgtgtatttgaagtctgtatgtggcctttaaggatgtgtttggggcgcagaagttctgggtaacagagaggctctcaaacgttagattttggattagactttgggtcaacttcagggtagcaagaggatggatacccgagaacatgttttctccgacttcctggcccctgtcttctaagttctgggtagtgatgggtctttggaggggcagccctttctgccatgtgaatctttgcccagccctgagggggtgagggctggccaagggagccgggccatggtcggagagaaggctgaggctccttgagaarcatttggagtttgagtcagttgtgtcttttaaaaaaattacccattttggacttgcctgtggaagcaattagagagatcacaggaccgtttctgattcccaattctgtccagtgtctattcagaaaaatagaaaacagtcaactggaacaggggattatttgagcacacacagagtcctgttgtctcagcagcgtgccctcagacaatttgccttttagtgaagtttaagcccatgaaaggaaataaaaagtgttttattagatggcaaagaaagatggactggacttatgagactttgagaatttttgctttttctttgttaatgcaaactttggaagagagcaactctttctgtaatgcaatttatttgtacaatgtggtagttattgttaatagctaataatgatcttcaactgggtaaaataccattgtgtgtttgagagggagagagagagagaagggtaggaggagaggragaatatcttttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcctcagcctccctcgtagctgggattgcaggtgcacgccaccacacccagctaatttttgtatttttagtagagacagggttttgccatgttggccaggctggtcttgaactcctgacctcaggtgatccacccacctcggcctctgaaagtgctgggattataggcatgagccaccatgccctgcctcaagcatctattttgtgcaagagcttgcagaagttctttcctgcyacagccgtggttggccacattgctcccccatgaatatgtggaaactgacacttcaggagaattggtggctcacccatggcattcagctagtgggttatggggcagagactcaaactcagccctgactcccacagcattgttctttttctgtaaattgctgacttactcagttgatcacagttcattgccgtttacagaatttgtctgcacccattgtgccttttaagtgtcgattttctttcctgaaagcacacaaagcaaagcacggctctgcagtgtgacccaccgtgtgctgtgtggacagatgatgctggtcagcaggcaggaaaacgatctgcyaggcgctgggggtggggcagaggattgttcttcctgaccttggtatgaaaaccgtrtggagttcttagtgaggaaaatcactcttagcccaaattcctgcgaaggccgatgggattgtttttaagatttgttggattgctggatttgttgaagggagaactggaagaagctatcagaagtttacagggcatcggagggagacactccctttggccactttctccgccaaaactatcctggttttagcccaacagtttcccacgcccgcccccacccccacaaccttgtttgtttaaagaccattaaagaacgtcttcaatttattctggattgagttttcctyaaaccaaaccacccctcagttcaccccccagagctgttsaggcccttcctgggggcttgtggctgtggctgcctcagatcagagcagaccctgggctgcatcatccttccacattgtctctctaaagtacctgaagccagtagttctcaaactttggagagggttttgagtcacctcgagagctgataagaacagaggcccagattgaagttgaatagtgctgggcctttgtttttaccaagttccctggatggttctgctacctcctagcctgtgagaactactcctttgtgatttcttgccattgaaattttttctcaccttcttcttggcttgagtgctcttctgggttccttccggctgtccaaatcaaatttaattttcacacccagaccttgtccctgctctcatccttcagcccaccctcctgttccccattcagcyagaccccctgccagtcagttcaagtgctaggcatggggtatcgagtctcaggccggtccacagacattccagcacctggtggtaagaggtgagtgctgcgtggacccactgaggaaggctctggctgtgctgggggaggggagtttatgctcrtcctcatagaaggataagcaggaattaagtgggcaaaggagggagtgaggaagctctcactttctaggtagtaggaccagcatgaaccaaggtaggggatgacaacatggctcattcagggaatttgaggtatgttgatacatggaaaaatgtacctgaaatgtgagtcctgcttttgtgactcaccctttcctttacataagcattgatttacatctgttgttttttaagatagkgtgtatgttgaaaagttcagaacaagatcaagtggagacataaaatggtaagatgtgaaaagttgttcttgccagattaaatggttccacctgaagaaaattttttttttttttgagatggagtctcactttgttgcatgggctggagtgtagtggcgtgatctcagctcactgcaacctccgcctcccgggttcaagcaattctcctgcctcagcctcccgagtagctgggactacaggtatacactgccaagcccggctaagtttttgtattttagtagagacggggtttcaccgtgttgccccaggctagtctcaaactcctgagctcaggcaatccccagcctcagccccccaaagtgctaggattacaggcatgagccaccgcacccggcctgaatttttttttgttttgtttatttatttcttggttttgctggcctttaagcaacccaagactagggggctttcactccgtccytagagagctcaaagggcctgacttaggggacacagtcagtgaaggggatgaatgaatgagtttcagatccaggtgttctggataagtcactttacctttctgggcctttttcctcaactccaaacagaggatgtcggtatagacaatccctaggatcttgtcccctttatgactgatcacacagttccactgcttgcccttgaggctttggtgtccrcgcatgcctattcagtctgacccacaagaggccaggccagctctgttccaggysctgaaaatcccattaaaactccactcactagcctgttccctgggggtgctgaatcagcatttaatggggaaggccacgagctaggctctggtgggtaggaagtgtgtgacttctcttacctcaacagtttctactgtaactagcgggataaggtaaatctatggaaatgcaaggcttatgccgaggctcacagagtgggccaggctgcataagtcctggacaccacagggcctgctttgagaaggcagctgtggtcccacagccttgaccaccaggcaccatcctctgttgccagtggacccacatttcaaatcattttatctcttaaataacctgtattcatttgttccttcccatgtcttatccaccaaaaatctccaattggaaattcagacaaggattgagaccctgtgttcttaaattgggttgattgaaatctagaaacaatgatagtaataacagagttatcttctctcgaacatctgcctcctgcctgatgttatttcgcttaattctctcaagggcttgaggagagtcctgccataatccttcctttcagaggggaagatcgaaatttagctcagatctcaagctagtaatcatcagaaccaggatatagaatcaggactagaccacatggtccctgctctgagctgctgcgggtccatccctgtggctctgtccagggtaaatggatgattcaggggaagggtcagcaaactatagcccatgggccaaatgcagccactgcttgtttttgggtggcccaagagccaagaatagtttccacatttttaaatgggtggagaaaacaaaatctacaaagaataatgtttcatgacacatgaaaattatgtaaaatatacatttaacgcttgtaartaaagttctgttggaactcagctacagtcgttagtttacatatcatcgatggctggtttcgcagtacaagggcacagtttaaagcctgccaggcctaaaatgtttactgtctggcctattacagaagacgtttgctgacccctgatttagggcattcatgaggcttgatgagatgttgaaaatcagctgtctcctcccgycactctcttctgattgtgggtaggctctggtgcaccagctctccagtgatctcctatctgatgctcagagttctttttccattgcatggatgtcaaataaaagtgtctgctttgtggcatttctggcttgagagtacctgcccaatgtgatttgccaaggtgccattttatcaaaagtcttaggatgactggatgggtttgccttgaatttgttttgcctttgctgatggttgtatttaggttatcattgaaagaggattgcagaacagcggcagtttcctgtgctgtctggattgaagttgaataatgccctaacttttaattgaaagggactgttgtaggcgggagactgtctaagagctgacctgtcaccaccacctgagatgtctgagcccacccttggactttcttggcacgtggggaagagggggcctgggtcctgggctcccacctaaactcagcagaccccactggcaggtgtgtgttgtgggggtgatggaggctttttggagggcattgagctccttgggtggaggtggggtggctgccttgggggctcagtgcagctctggccatgatggacagaaggagacaagaatgtagcttcttgttctgagaacttcagcccaagttcctcctttcatgcagcagaatccaagacactgacttgcccctctctgctgttgaggcttctgtgttgcagagataccttctggccctgctttatcctagtgaggcagctcacctctcccgtgtttcactgctcgaactctccttcccaaggctgtgctagtggtagtgatgacaataatagctactatttattgtgtgcccctcgtatgctaagtgcttcacgtagattatataatttaatacttgtcacaacagtcttatgaggtaaatactgtatatatatttaaaaagactatttttagagcagttttaggttcacagcaaaatgtagaggaagtttcacagagatatcccaagcaccccttgccattttctcttagttatgaaaatgatcaaatgggctgggtgtggtcccagcactttgggaggccaaggcgggtggatcaccggaggtcaggagtttgagaccagcctagccaacatggtgaaaccctgtctctactaaatacaaaaaattagctgggtgtagtggcacatgcctataatcccagctatttgggaggctgaggcaggagaattgtttgaacctgggaggtggaggttgcagtgagccgagattgcgccattgcactacagcctaggcaacaagagcaaaactctgtctcaaaaagaaaaaaaaaaaaaaaaagatcaaatagacttccaagtgcccatgtctcaggttcagtactgatcagcattttaccctcctttgcttcagctccctcctgtcattgctcattgctgagagtgggtaaggggctttctcaggttcctgtagctggtaggatcccgctgtcctcaaagttcctgcactcagtggctgacggtgccaggtgactcccccttttggggtccatgacatttgctgctgtttctaaagcccctactgtgtgctgctaatcccctcaccaagcttgcagagcggatggtaactgacaggtgaaaaaatgcaagaagttaggtcacgggtccggggacatcctgctaataggtggtggtgccaggcttcaaactcaggcctgacttcaagtcccgcagcttctctgccccaccctgtctctgtcctcctcacctctgtagtgtggtgggactcggtggggtggtcgtttgactgtgggaacttctgtttgcaaagccttggaaggacccaggtgactgcagatagttccgtgagaagcatctgggactgttgacctcactgctgatcttccttgtgagcctgtgatagggctaacccttggctttctggccagagtgtagacagagacccgattagcattttgtggtcagtcagaggcagtttgtgaacctggaacttggaagctggtttcctcctctgggagggatgtggagcctggggagccaggaaggcatggactgaatatacacccagctgggcagtggggaagggaggattccgtggggagctagccctgaacacagcaagcatttggtaaatggtgcctgttagctgtttttatccgtattctaaggtggacgagcggcgcaggagagaactggtaggattaatggagtggtttcattattcagatttaagtgcatgcagccagaagtcttcaactgaagaattgaaactctctgctcttttttgggggtcatggtggcagtgtgaggggctggttcatgagtgaggagaaaaggtagtggcaggcagaatggtacattttatattcatattgtgcacattattcacacctgacatgggccagaaatcctctcctaagagagacacttggaaagtaaacagtttgttaatcatttcaacccgtggactttggttgcagggtgcattttgatcaagggttacaaacaccaatgtcttcagggacatttggggacataaataaagggaatggacaaaaagatggaaaagcatactgcctctcagtctttcgcatgctcatgtttgatagagaaaatcaacatcgtgggggcagtgttgcttggcaactgccatttgtcctcagcgttggggtgacattactagggaatggctgtgaactccaagcacttccccccgggaagcgaggctgacactcagatccaattcatgtctttaatgtggccaaatgagaaagccagatgtatttctgagaagccaaaaaacaagatttaaaaaatgctatctccctaatttttttttttgagacagagttttgctcttgttgcccaggctggaggacagtggtgcgatcttggctcactgcaacctctgcctcccaggttcaagcgattctcctgcgtcagcctcccgagtagctaggattacaggccaccatgcccagctaatttttgtatatatatttttttcagtagagacggggwttcaccatgttacaggccaggctggtcttgaactcccttgaactcaggtgatccacctgcctcagcctctaaaagtgctgggattacaagtgtgagccactgcacctggcttctatctccctaatttttaaatacttaagattttaagaaacatcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaactactcggaaggctgaggctgggggatcgcttgagcccaggagtttaaggctgcagtgagctatgattgtgccattgtactctggcctgggccacagagtgagatcctgtctcaaaaaaacaaaaaacaaaacaaaaacaaattaaaaaacaaaacaaaccaaaaaaaccaaccaacacatttgcccaaatagtgaatcacatcaaattttaaaattcgctggaaactatctgcttcttaatttgattatacatcaattatgttcaaagtaaaaaacaaggtaatttgaaacagctgcttttatccaggtgtatacacggtgtatacatacacagatatrtatgaaatgtggaactctatacccgtatgtatggagttcctcmtaagagtctttttgagaaaatagttccattgctaaaaatacccaatggaaacttctggcctgggatttccaagttcaccctcggctgtgcrtctcaaagtccacacagcctcaccaaaatagcccttctgggtacttttttctgtgtgttcttggaggaggccatcgtgcctccagctccctaaggcggaagatgagccagcggggatctttgcagggtggttggttctcgttccttccaccgaagccttccatggcatttttgggacctggaattgtgaattattctgcctcttccccacagtccctgatgacagcatgaagttcagagagtttatttgcagatgaggcagggaagccggcctgttctcatcttgctgtgcctgatgccttgtgcttggggcactgttcactgtgctgcctgctgscctgcttgtctctgccttttggaygggagataggccaccccacagtgccacacctgccttcagggaagcttttgggtgttccttgtctggcttctgggttcagtgggagggcccacccagcctgtcattttaatgatttaccttagaggagccagttttatagggagttgttggataatcttcacaaggcagataaatgggagagcaggaagaatgatggcctttcagagttgaaatctgtgctgctccaaatcccataaactgctatttgattttaaacattgcttgaagcggttcacattttggttaattacgtcagtgggtaaaaataactattgtcatatggtgtgtgggcttggctttagaaggataaagagtctattgttacccattgtgctattcagtcacttattacccatccttaaaagcccaacgtggataacagaaaacctggagagctttgtcacttgctgaaatccaagctgccctgtgaatttatccccaaacactgctccttttgagaaacttgtacaagctgccttaattyagtcaattcaaatgggttgatgggggctgttcccaaggcccaggacaggcaggggtttgtgacctgcagccctggaactgcctttgggtttcatggtctcagttgagacctgcccagggttgaaccagcttagtgctccctgggggtggttaagttcaaggacttcagggtccgattgaccttgggctgaatcttgacctggggctgtaagatgctcrgtcaggaccttaacttttccaaggctcggtgtctacatctggaaaatggggataaacacagttcctccctgctgggattattgtaaggcttgaatgagatgataaatacaacatctgacttgcgactggacggtagcaaagggtttagttaatattataataagtagaatggaacagcattagattctcacacagggtcactatgttgttttctcccattctacccctgcatattaccctgaagcacccccaagcctctccctccccatccctcaagcccctccctccccatcccccaagctcaccaggtcctggcgcacccagatctttcactgcttttcttgcctgtgagctcttggggagtcaggaccaccttaagcaccctctgcatctttggcacctaacctggggcctggggccctgcagggccacaattagcagcatggacaacagcatggacggagagggtctcagagcctggagagctcctaggggctggagcagtcacaggaagtcaccaagtgaattgaagggtggtggctttggaggttcagtgaggcaagaagaaggctgttaggctgggaattaaggaaccttgtgttgttcgagtctcaggacaactcagatatggggtctgtattgcaaatgcccctgcgtcattttacaactgatgaaaacaatggctccacgagaccctcaagtgccagagctcatgagtgacagtggaagttgaactaaccttttaaccaccctagtccacacctgtcaggctgacgggctttcagtggtgatgtgttgggagctctgtgccgcagatctctgtgtgctcctgagactctgcccgcctgtctctaccctgctgtgcccactaggaggaggctgacctttatgttctacaccagtgggtgcccttggtctccagcttccagtgggccagtctggcgagagaccctagctggagatgaggggaggtagccttggcctctctccttgcccttcctcrctgctgctaccccaggattcttgcccatcccttactggttttccttaaccccaccctcacccttgaaaacagactctttaaaactctcctcactcaccctcattgagtgtgtcatctgctccagctaggatattggctaataccgcatgtttcagaaagaaaaattcgcagttctatttatttttttactgtggattgaagggagaggcaaccaggtatatggatgaaggagtagggcctggctgtcaccactggtgttcacaaaaggctcccgtttaagtcctcttatattccaaatgaggggttataggtcgagtcagggcgttgctctaacagaagcaaaaccaaaaatacacggccgtagatacaaccctgttctggtacttcctaattttgtgtgtacatgtgtgcacctggagcttcaagaaatgaaaatggaaatggcctgagtgtttctcagccctaggatgaggctgtttctgtgatttagggctggaggttatgaagacttggtttacaatatgcacagtacagaagcggggaagtcaaggtgtgctgggcaaggaaacatctttatgtgacccacaaagagtgaagcagagggaagaaccagaagttattytggtttgcagactgggagacaggtttaatgacacagtcatgtcagagagaggggaagaggagaatacgtagggggtctgttttgatgtgtawgtacatgtaggattttcatgtagaggagttggggaaaattttagaagttttaggtgtaaatgcagctggtaagatccttatgacttagtttctttyttttcttcttttcttttctttctttctttctttyttyttttttttttttttttaagacagagtctcactctgttgcccaggctggagtgcagtggcgcgatctcagctcactgcaacctccgtctccccagttcaagcaattctcctgcctcagcctcccagagtgctgggattacaggtgcatgcaaccacacctggctaatttttgtatttttagtagagttggggtttcaccatgttggccaggctggtctggaactcctgacctcaggtgatccacctgccttggcctcacaaagtgctgggattacaagtgtgagccactgctcccggccttagtttttgagtgggaagaatctagtgttcagagtggaccactgatgtcatagctgcaggtttggctgaattgggatggtgcagaaagccgtgttaaccatttctttttctctgaggcctggaggaggakccttgtgactggaaccacagttgggactggcagtggtttttcctgctggcaaggaaaaaaaaaaagagaaaagaaagagttcgacttatcagcacaaagaaaggaggatgtgaaactagaaccatctctagggcagttctagcaatgaacaaggctggaaggctcaccggcgaggggtttcccctcaggaaaggggacagagaagcttccacctcctgggtagcattgggtgttcctgggcacatctgggtgactaacgggttttctgccacacaactggggtatatagggaagtctttggccagaactgtgggccgtactgcattcttcccgtgtctgtcactgctgagtcgtgagcttgatctcttttcttagtgtttgctccttttgtccagctrtgggggccagcagaagctttgggtcatctgtaccagtgactttgctgtgaagatgtaagggagagtggttgaggtcaagatctgggttctggttcttgtgcctcctctctggctgtgtgtccttcaacaagctgcttactgtctctgggcctcygtgccctctgcaactgggttgttggtctatttaaatacttggagaaaaaagctgggcatggtggctcatgcctgtaatcccagcactttgggaagccaaggtgggaggattgcttgagcccaggagcttctgaccaatctgggcaacaaagtgagatgctgtccccatacagaaataaaaaaattagctgggcatggtggtgcatgcctgtagtcccagctacttgggaggcttaggtgagaggatcgcttgagcatgtgggatcaaggatgcagtgagctgtgattgcaccactgcactccagcctgtgacagagtgagaccttgtctcttaagaaaaaagttattcaaaaaatactttggaaaacaatgctggggagagtatgagcttcagattgcacattggtttctatcaggaggatctgagcctcggtggtgttacctgtaaaatggggataaaaatacctcacagggttgcagtgaagatgtaaggatgatgatgatgacaacagcagctcaaatagatcatttaacttaattctcgccaaagcaaggcagrtacaaagatcatcctgttggcagatacagacagggagggacagagaggttaattaagcaagctacctgcccgcagttacatggccagmagcagtggcactgaacgacttccttcaggcggtctgagtccaggtctcagctcttagccatcactccatggttctgtgctgagacaagggatgtagaaagcccagcacagtgtctgttacatagtaggtgcttagtaagttagasttcctttttatcctcagaatgcgtttgcaagtatagcctcccacagtgcttttactttaatctttccccttactgggcaaaaaaatgtttgctgccctgtgcgacttgcctagctattgacttctcttttttctgcctctctcctatgatccatcctagactgtggattgaggctcagcctagattaaagggcaggggctggaggaggaagatgagctgaaaaagggtaggcctgaggcgcgaaggagttgatggtagggtggaaggtgggaatgggaagtttgagaattggaggacctgggggcaagactttccccctctgggctcgttctttccttcctgtgccgtttattgagtgcctactgggtccaccattctaggcatggggcacagacaagatctctgttctcatggagcacacagtgtggttggaggagtcagtgatggacagagagtgaggggtgttggtttccatggctgctcggagaaggacttgctgaggaggtggcgttttgggcaggccatgaaaaggtctgggcagagtgtgtttgtgggagggaataaatatgtaaaggctctaggggagaatcagtttcgagaatgtgagggggcagtgagaccagaggggctagtgggctgtggctgagtttgaattttattctaagtgtcatggaaagtaggaggacggttttttccaccrgggtcctttttgattattttattcttcgtgacgatcctacttaaaaaaaaaaatcttattcaccaaaaaggtgtgtttgtgaaacaatagagtgtacaaccttgaatcactttagatttttaaagtatagggaaacaattatggatcacaatgaatatccttgagggctgctcccctccccagctgacactgtcagctaaacctttaaggcctcttgtgtgtcaagcattaattcttcccaaagctgcttgacatgtgattaaaaatttttactgccacctactgatggaaagaagaagatgaatttttgtacaatgaaaatcccaaacacagtggatttctggtttccactgtgctgtcaggactgggaaatgggtctggggaaggggtgtgctgggcttggtatcccccccacccaaccccctttttttggccctgacaatctggtctctgcttctgtgtccttctgcttcagctcatcgcacagtgggtggagggaggtgctgacctggggagttgctccggggagagggctggaggtggggggatgtgtctggggagaaacactgggcactgggagtcagcagccgccagcccccacataacccagttaatcctttgtaattgaccccgaggttgcaatgattccctgtgtttaatgtcccaagacggcctaaccctgaccagcagacctttgcttaatgtgcttcttaccaccccacccccattattaaatcctcaactgctttatttctgatttgcattttccatggctgaatgaatctgctgacttccgttttctttttctgtttcagatcytgtgcgcaggtggcagtgagtacccttttcctctctattcttgtgttgttcgctactgccccctaatggacacacagcaacattaacagcaatgtgaaatgctaatttattaaaacctgctcggtttccaatttttctttttctttttcttttctttttttttgagttggagcctcgctctgtagcccaggctggagtgcagtggtgccatctcggctcactgcaacctccgcctcccgggttcaagtgattctcctgcctcagcctagcaagtagctgggattacaggcacgtgccaccatgtccggctaattttttgtatttttagtagagacggggcttccccatgttggtcttgaactcctgacctcaggtgatccgcccgccttggcctcccaaagcgctgggattacaggcgcgagccaccacgcccggccccaatttttctttagaagtaggagtgagggtggaaacaacaaatgaaagaaaaaattttaattaattgtgcaatcatgatgaaaatttatattttctgtaatttttttctagcctcatctgtgggcgatttaacttagttgaaattrtaatacattatttgtatattgtttatgtgctgttatcctttaagtattttcttgtgttgctacattgcccttttgttgctacattgctacatttaaagaatggggtggaagatcgtcataacctttggaaaatgagacctggactcccgcatgttttgctttcatgcacagggctgagtcccaactgctgacagtgctggttcattccctggtaataaaatgagaaaaataaggatatgactagaagttttttaaggaagcttaaatatattcagttgaaagcaccatccatccctggattatgtccttactaattttttggtcataaaacatttctataagaattgaaggccgggcctggtggctcatgcctgtaatcccagcactttgggaggctgaggcaggtggatcacctgaattcaggagttcgagamcagcttggccaacatggtgaaacaccatctgtactaaaaataccaaaaaaattagccaggtgtggtggcatgcacctgtaatcccagctacttgggaggytgaggcaggagaatcgcttgascctgagaggtggaggctgcagtgagccgagatcactccattgcactccagcctgggcaacaagagtgaaactccatctcaaaaaaaaaaaaaaaaaaaaaaattaaaaataatagtagttggtagtttttwaaaaaatgtaccttttaggaaaaaaaaaaaaaccatggtttttgtttctccccaaaatttgggaactttttttttcctgattggtaaaatctcagtttgtgagataaaataattagattgtactcatggaagcatatatgggcagatcttgctgaaatcttctaataaagcaaatctcaattaataatggtaattaragcctgtgcaaacaatgggaagagtactgccgttggtttttcttcctgttaattagtttaataaataaactggtgggtaccttgtacaggcttgaatcactgctgcagaagaacacttctattcaaacatctaccgtaggtagtagaattgcgggaaacagaaatcatgagctattttaactgaaaggatttaccctgggaagtgagagtttacagagtcattggaagggccgctgtattagtttgccagggctgctgtaataagatcaaggtcttgggggttaggacttcaacatatgaatttgggggtggcrgagcacaagtcagctcataacagctggggaggaggctttaggcctggccctgagaaattactcccagactaaggctgcagaactgaccccctagagagtcaccaccttggtcatagacagcaagcagaragggaggaatcaggaagtccctgctgtagttgctggatccagcggtgaatgttctgagctgtgatcctgggatcaggaagctgcagccactgccacagtgttggttctagagccaggcagcatgagatccagtcatcgcatccacactacagctataagaaggaggaagggcagaaggttgtgctccaccctttaaggacacttgctagaagtcagacagaacgtctggtcacactctgtttgacagaagttagtcacatgcaacatctagctgcatgggaggctgggaaatgtggtctttgttcccaacagctatgcatatacagggccaaaaatctccaggagtatgatgaagggaaaatgggggaatggagtttgggggtcaagagtggtctctgctgcacctccctgaacagagactctaggagactagtaatgaattcaagataaagcagccagtgtggccaaggttctccttcagtgcctgagctcttggccataggagctcacgcctcctctcctttcctgtgaatgactgtgtgcagtgtaagcatggagcttctgcactctcgtggccaggtactctccatgtggccagaaatggcagtttctgaggggctcatgttgtaggtgatgatacaaagaagagaaagagagggatcagtttttccaagtgtgsatttcatttcagtgtaaatattktgtgaggtggggcatccctgtctcctggagaartatatttttaatctaattgtttactttctttgcatagcccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactggtaagcataggcttttctgccagtcatgtttcttaaaggaaatcggtagaatttataaatgtcatgttttccaaatactgttcttcttttaattacctaagaaaatcttttwaaaaatttttataaagatagtaatgcatattcattatataaaacatagacaagaaaagaataacaagtaaatcattaactggagataaccattgatcacttgatatacgagttttataattttaagatatatgcatgcctgtgtgcatatgtatatacatatatatgttttattttgttttacaaatatcaaggtcatcctttacatgtagcttctcaccaatatattacaaatattcttccctgttagtatatacatttctacaggacagttttaatacctgcctggcattctattttctaaatcagggttggcagataataatggtccttgggccaaatatagatcactttctgtttttgtaagtaaagttttattgagtctgcctatggctgctttcatgctagaattgagtagtggcaatggagaatttgtggcttgtaaagcctgaaatatttattctgtggcccttacagaaaaacattgctgatacctgggttagataattgattctaaaactgtggttcagagatctctaggggtctcctagattctttcaaggtatttctgggtattgttttcataatactactaacatgttatttggcttctttactctcattktatcatgagtgtacrgtggagtcttgcagattctatatgatttgggatgacactgtcactcttacagctaatggaatgtatgctttcatattgtttaaaaaactttatcttttttatttctaatacagtatggtaaatattaatcaatataacccatataaacaaaaattctccgggagccttaataatttttaagaagttaaaagggccctgagaccacagtgtttaagaattacttgtctaaaagcattgtaaattatttaactgctcccctgttgttgggaaggtagattatttatttataatttttcataaaaaacattgtgatacaatagttttgttagttctagaagtattgataaaatcacatacacagttaaaataagtcattgaattatttctagggtaatatgagaaacttttagaaattcctaaggggctgggcacagtggctcatgcctgtaatcacagcactttgggaggctaaggtgggtgatcacctgaggtcaggagttcaaggccagcctggccaacatggcaaaaccccgtctctgttaaaaatacaaaaattagccgggtgtggtcatgcatgcctgtaatcccagctactcgggaggctgaggcaggagaattgcttgaacccaggaggcagaggttgcagtgagtggagatggtgccactgcactcccgacagagtgagactctgtctcaaaaaaaaaaaaaaaaaaaaaaaaaaaaagaaaaattcctagcaagcttatgttaattattgttacaaaaatttgggcttagaggttgggaccataccagatggtcttcccagaaatcactggacaggcttactgttgaagggcatttccagaggaagccaatctacaatgattggaataagaacctacttcttcaaatatacagacatcaacacagagtcacaaggatcaagaataatcagggaaacgtgatattaccagagaaacaaaataaagtgcaagtggttgmccataaagagatgggagatgtatgaactgtctgacagagaattcaaaatacatgttttaaggaagcctagcaaactttaagaaaatacagataaagaattcaaagaaatgaggaaaacaataagtgactagattgagatatttaacagagaagcaaacagaaattctgaagctaaaaaatactttgaacaaaatgaaaaatgtaatagagagcaccaagagtagaactgatcaagtagaagaaataatccttgaacttgaagacagattatttgaaaatatacagaggaggaaaaataaaaaagtggataaaaaggaatgaagaatgcctataggatttatgcaacagcatcaaaagacgtggtatttgaattggagttcatctaggggaagagaaagataaagaggtagaaagcttatttaaagaaatagtagcagaaaactctccaaacctggagaaagatataaatatccaggtacaggaaggacaaatgactccaatcagagtcaattcaaacaagactactccagaacataatcacactgtcaaacatcacagacaatggggatttggaaagcaaaaagagaaaagaagcaaataacatgtaagggagctccacttcagctagcagcagacttctcagcagaaacttacaggccaggagagagtgggatgatatattcaccatgctgagggaaaacaacctgccaaccaagattrctatacccagcagaactggccatcaaaaatgaaggcaagataaaagactttaccagagaaacaaaagctgagggagttcatcaccactagacatgtcttataagaaatgctaaagagagtttttaagctgaaagaaaaggacactagtgattaattgaaaacatatgaaaggataagactagtaaaataaatacacagtcaaattcagaatacatgaatactgtaatggtcatacatatctttaatatgaaagttaaaagataatacttaaaaaataataactacaataacttgcaggggggatatgcaatataaaaagatgtaaatggtgacataaacaattcataatatgagtggggaatggactagaagtgtagaggtcaatttgtgtgtgtgatcaaagttgtcatcagcataaaataacctgttataactataagattctttttataagcctcatggtaaccacaaagaagaacctttagtagatacacaaaaaataaaaagcaagraatcaaaacatactactagagaatatcacttaacctcaaaggaagatagtaagagaggacggaaggaacaaagagtctataaaacaaccaaatggcagtagtaagttcttacctatcaataataaccttgaaagtaaagggtttaaattctccaatcaaaagacatagagtgcgtgaatgggttaaaaaaaaaaaccgatctcaatagtatgctgtctacaagagactcacctcacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatatatgcacccagcattggaatgcctaaatatataaagcaaatattaatggatctgaatggacagattgactgcaatgcattcatagtagaggacttccaccaccttacttccagcaatggacaatgatccagacaggaaatcaataaggaagcatcagacttaaactacagtttagaccaaatggatgtatcagacatatacagaacattccatccaacagctgtagaatacacacttttcaactgcacctggaacattctccaggtagatcatatgttagaccacaaaacaagtsttaacagatttaagaagtgtgaaatcatatcaagtatcttttctgatgatggcatcaaactagaaataaataacaggaggaacttaagaaaattcacagatatatggaaattaaacaacatgctcctgaataactaatgggttgatgatgaaattaaaagggaaactaaaaaatatcttgagacaaacatcacttcttaagcaattttgttaacatatttctttttcttctttaaaatggtgccataacctccttcatgaaattgctgtgagacataaattagaaaatgcttgtacagcccctggtataggatctgtccccaggtcacttacagcaggtccccagcaggggtcatgctgatcttgccatctcccacagtaactattgttaattgttttgtcacaaatgcccctgaacaatcaatgggtcagtgaagaaattaaaagggacatttaaaaatttcttgaagcaaatgaaaatggaaacacaatatactaaagcctatgggatacaccaaaagcagcccttccaagaaagttgacagcaataaactcctacatcaaaaaagaaagctccctgggcacagtggctcgtgcctgtaatcccagaactttgggaggccgagatgggcggatcacttgaggtcaggagttcgagaccagcctggccaacatggtgaaaccccgtctctactaaaaatacaaaaattagctgggtgtagtgacacacacctgtaatcccagctactaggaaggctgaggcaggagaattgcttgaacccagagggcagagattgcagtgagccgagatcgcaccactgcactccagcctgggcaacagagcaagattytgtctcaaaaaaaaaaaaaaaaaaaaaaaaaaaaaaaaagcaagctcatacctccagcctgggttttgagagcctgtctgaaaaaaacaaaacaaaaccctcaagtaaayaacctaatgtagcacgttaaggaactagaaaaataagaacaaactaatcttcaaattagtaaaaggaacaaaataataaaggtcaaagctgaaataaatgaaataggcactagaaaaacaatagaaaagatcaataaactaagttgtttttttgaaaacaaagaacattgacaaagctttagctagactaagaaaaaagagacgctactcaaataagaaaatcagaaatgagacattataaactgataccacagaaatacaaaggaacaattatgaacaattatatgccaacaaattggataacctagaagaaatggataaattccttgccatataccatttactatgattgaattatgaagaaatagaaaatctgaataatccaataatgagttaggagattgaatcagtaatagaccatctcccatttctatttattactgttgttattctaagagacagtgactccctctgtcacccaggctggagtacagtggtgtgatcatagatcactgtaagttgaactcctgggctgaaatgatccttctgccttagcctctcaagtagctgtggctattggtgtgcaccactacatccagctaacttttaaaatttttttgtagagatggggtctcactgtgttgcccaggctgctcttgaactcccagcctcaagtgacccccaccaccttggcctcccgaagtgctgagattacaggtgtgagccacccagtcctctgccaaacctttaaagaagatctaatgacagttcttctcaattgcttccaaaaattgaggaggagagaatacttccaaactcatttaacaagagcagtattaccttgatacgaaaaccagacaaggatacaacccaaaacactataggccaagatgcaaaaatctttaaccaaatactagcaaacctaatttaacagcatattaaagagatcattcaccatgatcaactgggattcttcctagaaatacaaaaagggttcaacctgtgcaaaacaataaatgtgctacaccatattaacagaatggaggacagaaaccatacaatcatttcagtagatgcagaaaaaacatttgaccaaaaaatattgttaactgtgctttcttttctgaacttaagaacttgcttttccaaaaccttmccagaatccctgtatgaatcaacaaaatttagttcttaacacatttctccttctttaaaatggtgacattagctgggcatgatggtgtgtgcctttaatcccagctacttgggaggctgaggcaggagaatcgcctgaacccgggaggcagaggttgcagtgagccragatcacgccactacactccagtctgggtgacgagcaagacttcgtctcaaaaaaaaaaaaaaaaaaaaaagaaataatggtgccatacctttctcatgaagttgttgtgaggcataaatgagaacatacttgtacagcatctgggacatggacggcctctcaaaaggagtgctgctgttcttgctacctgcaccactgtaactgatgttgtttcatcatcctcrtcaccatcattgttattgattgtaaatggaagcacagtggtcatcttccaaatatgccactctgactctgtgaacttgtcactttataaagaggaaattcaagcttggaggggccttctggcatgacgtttattgaattgtggggcacaagatrcttccctgcttgttccattttcctttctcttgtttattctcctgccttatttatttattttttcttttgagacagagtcttgctctgttgcccaggctggagtgcagtggtgtgatcttggttcactgcaaactctgcctcctgggttcaagtgattctcctgcctcagcttcccgagtagctgggatcacaggtggctgccaccatgcscaattaatttttgtatttttggtagagacggggtttcaccatgttggccaggctggtgtcgaactcctgacctcaagtgatctgatctgcctgcctcagcctcccaaagtgctgggattacaggcatgagccagtgtgcctrgcttcctgcagtttttttattgattggatgaatgtttgtatatcccatgagccagatgaggcacactgtccatgcacatagcaagatggtaacacttacaccatctttactcttttgggattagtcccaagctccttgagaatgactgccgtatcacctgggttttactcttcggtttctggttgttactcctcagtcttcagctcaattaggatgcatccatttggtagttttacagttagtaaccctgatggcttccactggtttacgatcttgtacatctaagatgatgaaactaaggttcagagaggtgagatgactttgagtaaaattgcatggtgagcaactagcagaattggaccctgaaaccagatttctaatgtccaaatcttgtcccttgtttatcatatcatggtggttcaataataattcttcgtgtttagtgtggtgtactagagctatcaacagagaaacttgagactgagaggtttgaagggactaattctaggtcacacagctaatggatggagcaggtctttaatcccagatctgggttccaagaccagtccttttctctttacgctgctctgyccctgctatctktatktcagaaaaccactgagcttccttctagatgtcagggtttggcaaaaaagttatcatgtgcttctgcgtcatgcagcgttttctgagaatggggagagggactcattttgcatctttgatctctcttttttattttgagatggagtctcrgtcttgtcgcccaggctggagtgcagtggcgcgatctyggctcactgcaacctccacctcccgggttcaagtgattctactgcctcagcctcccgagtagctaggattacaggtgactgccaccacacccagctaatttttttttgttttttttgtttttttagtagaggtggggtttcaccatgttggccaggstggtcttgaactcctgacctcaggtgatccaccygccttgacctcctaaagtttggtctctttttgtatcagcttctatacagacttaaccccatttttaagtcacagccagcatggtcaacttctgtcagttttgcttctgttccaaaggcttctgttttactaacatacacacatacatgtatgcatatggatttaaataaattctggtgcagggaagtctaggaggcaaagagagataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcartgagacttggggagatcccagagtcataaaagtcatcacaggtaagatgactggctcccagggatgatgacaaaccatttcttattatggtgtattctagggccttgtccgttcaagttgcctgttggaaagagaatggttttcataaactagaagaggagaaaaggtgctatgttgtttcaagcctgggatttctggtggccacatcattcagtattaaggccctatgtgttttgggaagttctaactacttctgtttggtttttaaaatcttttgttattgttggttaacacctacctttctgttaagactcaggagtagagacttccttaaaaacgcgtgtcttcatggtaattaccagccttttaagctcccaggaaattgatgctgtgtttatattcccaggagtttctgttgggcaggaaagtttggtgtattttataggggagtgtgtgtttcaaatgaaataagagtttgatgatatttaaattttaattcagatttgacagtttagattttgatttatcttagatgtcaataccgaagccatctattatagctgcaaacttagctttttttttaagctgaaaagaaccaaacattttaaaaaacaggtggagaaacttttttaaggtgaggagaaccaaaaattgaagaaagaggtcctctgttagttttctgatctagggggctggggagtgtgatctcaggggctggagtcggccatgggcgcctgagctcttggagcccacggctggaggtgaacgaggtccagcgtggagcagcaaatatgaaaccagtggcttccgacattttaagtcaggaaactatttctttaaacaaaaccttgcccaggagcccaaaaagtaaaaataaaaaactggagagaaaagagccaaagaaatgggagtcacgggcaccctgacaaaactcctggagctcctcagagcactattttaggggggaamacctgccataaaggtttgctctgttacattgtgaaagagagggaaaggagagcacagagagatgacagaagagaagagaatgagagaaaagagcatagaacttggaaatggtcatgaggacaaggtgaccccragggggtggctgtgggaaaggggatgcggaggtgcaggaagcaccggtagaggggytgagtgtccttatctagcttaaagccctgagcacagggctgcatgggagcaggtccatcagctgctgcgtattgagcacggcacatgtgcctctctgtccttaatgttattttgtcctcacagtaaccctgggggctgcagcagaagacactgtaatgtggagaagttaagtttcttccggtgtctcagagttactgagtatcaagtggtggggctggaacccggagtctaactctagaccactgtggtgcagtgatgttcataacagctatccacagtcaccgagctrggaatttattggttctgcattacttaataaaacaaaaagacgcatgactgacctgatttagaactctttgcatgagagacatgtgctgtgaagaatcatcttaccgtttcggagctggacrgtgccttagaatcatctaggccgatgtctttaccttcaggcccctgcagccctcaggaggggttttgctctatctgcagcactacctgtgcttttctgtacatgaagctgcagccctgggttctcctgtccccactgctaccaggagtgtgtgttcttgagcaagcccccctgcctctctgggtcttcgtgttcttattggaaaagtgaggggagtgcatgtcattttgggtgaagtggtttgacttatgtcaccatcaaccaaataacgcgatgggaggaaggtccaggatatagtggagatggaacgtcttctgaaaaatccccttggtgctgggatattgaatgtgctgcttacttgaaatgtcttggtaatttaaaatgatattatttgcattatcttgaattgagacctttagattaktaaacagtcactttatttgaggctttgttcctgatatctaaaacacatacaattaaatgctaccatttaaaagggacagtttagaagagtgtccagtcactattggggttaatcttggagaacagtgtggatcctaaacaatttcagttttaaggtttttttcttctcttccgtgttattattttctcccccagccctgctgtgaaatgatggaaatgcattgggctctgatagaaaggaagtatttttagtgagtcacattgggacatcagtgacctcagtcattctttctttttttcttttaaaacccgctcccagcactgaaccccagtcattcttaatgaaggtgactgcatatatcttgttccattaatgcatgttgtatttttaaaatagarccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttgggtgagttacaaagggtaccttcygtctcccttactggttcttactttcagtaactaaatgttctaaaaaataaattgctcttccatgtgtatggagatttagaatttataaagggcttttcctccacattttagtttgatcccccacctgcatgaggaaggaaggaaacgtgttctgattttacaggggaacacaytggggctgakaacagcaataggaattgaaactttttagagtctggcacccaggaaagttagaggcccctttagctttctatctaacagctgtgtcaacccaagttgggccttcagaggaacttatcaygtctgctggttgatgttggcgttgtcatttgcaggtttcatagcatttgcagaggatccccaggataactccatgaggaggacaggcacttaatctgcattttatacttaagaaaacagagctacagagtgggtgtcaggatccttgcttgcgagtgacagaaaccagactttggatagctcagacagaaggaacaatttattggctcaygtggattttcctgctagcgggaggccttagagaaagagatgaggcaattctcatccctccctcttgcttctttctgttcatcagcttcattctcagagcagctccctctgcacacttaaggagcccagctgctccygtttcacaccctgcagctgccycaccagccagctgccccaccaaccagggtctggtccagggaaacgtgtcttgagtggggtctgattagcaaagtctgcttcacagagctgtccctggaaatccatgctgggacaggagaagataacaacccaaagaagggagaatgacctgaaataagcagagtttgaaagagaagcaccagatatctgtggtgctactggaataacagtacaaatggagatggagctatcaggcctttttatggggctgcctctctctctggaggaggaagggagcagatattgatggagcaccaactgtggccactgtctgatggccatctgatgggrttggggctccgaaggaaaatgggggatgtgtccctcttgtggttgatgtctttttgtctcctgtgcttgaaacagatrccagcaatacagagagaagccgggcagggagccccaccgcccctgtgcatgatgagtccctcgtgggacctgtggacccatcctccggccagcagtcccragacacggaagtcctgcttgtcgggttagagcctggcacccgatacaatgccaccgtttattcccaagcagcgaatggcacagaaggacagccccaggccatagagttcaggacaagtaggttgaactttgtaaaatggtggcagccagagtttcctagcacaatgttctgtctcctgtgattctgattctgagtgatttcttgcataacagctagttttgatgtcagagggagcttcctggaggagattttggacagagcagatctgctcagtttcttcttaactccatgggcagtgcacatctctcattaagtgaaatcaaatacatggagcagcccctgtgtgcgggcaccaggcactgcctcacgccatctttcacagctttgcgtggtggctgatgagacaaactggcatcatactttcctcttaaaaacaaataatcattgcttgtttttcctttgctttgagttaagaaagttatgaaagtgagtttcattttttcacccgccttgtaattcataccgatctttctgttgaaatgcttgttgacatgcacattgctgcttcctcgctataatttatcagcactttcactctgtaagttcaccaatatttggaggctttggtgaaaagagcgggaggtgaacacatttgggaatacttagaggtagttactggccaggctgtgttacttgtacagggctagaagttttggcaagacattggtgagaagccattctgtaaggaatgacagtttttcctggtatccatgttgaaggagggtccatttgtgtccttccttccctttgtacttgttttgctaatgtgggagtgggtggggaggatgcggccgtaggacaggctgcctgacctcatggggcctgcagtgacctggcaggagtggcaggtgggaggctctcgggtgaggagggcttggattccagagggtgggttagttggaggaggaggaaggggctcctatgtgggtgcggttggcagtggtggggtgtcctgcacatggtaagcttgcgtgagagagtgaaaggggctgaaatctggtctgtgtgccctgcrtcaagccatgcacccagggctgggtccagccaggggaaggtccctttgactgatttgctaaaaggacttgtagatttgtgtgggcctggggtccctgctttttaaagcagtttgagcaaaagcaaagtagtagtgattacatctcaggctcttggtggtgtgaattcacacacatcctgctttgggttgaactgtcttcatgcttggtaaataatcattatagtagcctttccctctctataaggggcgagtgtgtgtgtatagataagtcttagtcagtttgggctgctgtaacaaatggccatgcactagatggcgtaaacaatgaacatttatttctcagggttctggaggctggaagtctgagactggggtgcagcatgcctgggctccgggtgaaacaccctcttcctcttccaggttgcagactccctgggtcttcacgtggttgaaggggtgagggcgtggtttctctccagcctttttgataagggcactaataccattcaggagggaggtaattcatgatctaattacctcccaaaagccccgcctcctaaaagcatcacatcaggggttacaatttcaacataggaattttatggggacagaaacattcagtctgttgcaacacacacacacacacacacacacacacacacacacacacacatacagataaacaaacacacatttccacccaccccagagcaccctgcacttttcaagtgactagttaggtggggcagggttaaggaraccatcagaggacattgttgaggcacccaagacacgacagaaagccacctctagggctgaagggctagaggaggacagggtgtttctggagcccagtgagagctggggcagtggtggacacagctgtgtcaggacaggaggcccagagcaggaggygatggaggaaggcactgactcctttctcctgtggcccttcaggggcctgcccattggctcatagtggaacccggtcacagcccatgtggcaagaccccccatgatgccttgcacaaggtcagcctcctgggcccagagcaggtgagggaagggcagtggatatgtcgggaggrtggagtgggcaggtggtgaataactggcactcgggttatcttttcttgaggttaggattgctctccagttttataggtgaggaagctgagctcaagtggttttcctgtggcccacctgggtgtcatagcagagtgagccctggaayccaggcctgcctcrtcctgacttctgtgatctcgggcgatcacatagatcgcastgttcgctcttgcatcatgtgtgtttgacracttttctgggtgcccctggccctagggtaagacatgcatagagtccaagtcatcatttaggtcaaatctctaaagtcaacttacaaaaaggaacaaagaataaccctgcaggtgccattggccaggttgtttcttcaccgcccaatgatgcctgactttggctgggaccgtcatgctttcctagccacggttgatggtgcagaggaggaaggaacactcccccaggagagtttgctgggcttgacagcatgccctgatgacctctccctccctctgccttggccgttctggttattttgaactcctcttgtgttctcacagatgctattcaggtttttgacrtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcrcgctgtcatccccggactccgctccagcaccttctacaacatcacagtgtgtcctgtcctaggtgacatcgagggcacgccgggcttcctccaagtgcrcacccgtgagttcatgcctggctctcaccaccctttcctgctgtcytgctccgtgccaggcccagacacaggatgcatgatgtagtaatggtgactgttggctgaccacacgccaagcttcgtgtgacatgctttccttgcactggcacattgtatgctcacaayagccctgtgatgtggttggaagtagccttattttatagataggaagccaaggctgagagagktgctagacaggtatcacagctggaaagtggcagaggtgagattaagcctctggtatttctcacctggagcctgcgcttgtaactctctttccagtgtggaggagacctagagtgaattgatacagggagacaaaaatgacctggtattcatatccccttgtgtcttgggtgctgacattataacgaatcactggcacagctgtatctcatctttgtttgtttaaatgtcccttaaaaataagattttatgcagcaaataaaaagctttaggtttcaaagaaggtccgataatgtaaaataaaacagtaatggtgcactagtagtacagtggtataatattgattatatactattaaacaatagtagtgacaccagcactgcattttgcactgtgccatgagatttatagacactgtagtggcctccgaggtaggtattggggtccccttttacagatgaggaaatgacaccctgatggctgaacagtttgcccaaagccacagagctagtgagtagcagagcaggacttgaactcaggggtgtgtggctctggacccaggcttatcccacaagaatgtccattccttcgcaggaagcacaccttagcattcttatagatgtattttggactggatctttgggaaaatgaaatatgcttgcatttctttaccttttactcttttactatttattagttaggattaggttcagccacgaataacaccaccaaaaacaacaacaacaaaacccaagtatccrtggcttaaacaagacaggggtttatttctctctcctgtaacagaagcccagtgctaggcaggatggggatgatagaggttatccaaggctcagttgtatgaaacagaaactgtgagctattttaaccaaaagggayttatcctgggaattgaggttttgcagaatcattggaagagctggtgtattagtttgctagggctaccagaacaagtaccaaaggctgtgtggcttgaacagaaatakactttctcatagttctggaggctgaaggtcaaagattaaggcaacggcaggtgtggtttcttctgaggcctccctcttggcttatagatgactgtcttctccctcacatggttgtccttagtctgcgtgtgcctatgccctcatctccctttataaggacaccagtcttgctggattagggcctaccttcatgacctcacattaacttaattacctctttgaagaccctgtctccaaagacagccacattctgaggtcttgggggttaggacataaacatacacatttgggggtgagggagcacaagtcagctcataacagttgaggagcaggctttaggcctcgccccaagaaatgactcctggactaagtctgcagaactgaccccctggagagtcaccaccttggtcacagacagcagagggaggaatcaggaagtctctgctgtagttgcgggatccaggggtstatgttctgagctgtgatcctgggatcaggaagctgcagccaccgctgaggttttggttctagagccaggcagcgtgagctccagtcattgcatccacactacaggtataagaaggaggaagggcagaaggttgtgccccacccttaaaggacacttcctagaagtcacccagtacctctgctcatgcttcgttgagcaaaacttaktcacattgcaacatctagctccatgggagctgggaaatgtggtctttgtttccaacaggtatgcacacacagggctaaaaatctgggtgggtatgatgaagggaaaatgggggaatggattttgggggtcaagactggtctctctctgctgtccctccctgaacagaggctctgggaggctagtaatgcattcgagataaagcagccagtgtggccaaggttctcctccagagcctgagcccttgaccacaggagctcacgcctcctctcatttcctgtgaatgattgtgtgcaatgtaagcacagagcttctgcactctcatgatmaagtgctctctccatggccagaaacagcagtttctgaggggctcatgttgtaggtgatgatacaaagaagacagagagagggatcaggtgtcctaagtgtacatttcatctcagtattttctgaggtggggcatccctgtctcctggagaagtatatttttaatctagttgtttactttctttgcatagcccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttccaaatattgtttttsttttaattatctaagaaaaaactttaaaaattttcataacactaatgcttatttattatatgaaatacagacaagtaagtagaaaaaacttacatggaaaccatcaagcagagataatcacttttgatgtatgacattttacaatttttaaacatatacatatagatacacaaatatatgtgtgagtatacatatatttaatacatatatatttaatatttaatacacacacacacacacacacayatatatatatatatatwtwtttttttttttttttttttttttgagacagtcttaccctgtcacccaggctggagtgcagtggcatgatcttggctcactgcaacctccatctcctgggttcaagtgaagcgattcttgtgcctcagcctcctgagtaattggaattacaggtgtgcaccaccatgcctggctaatttttatagttttagtagagacagggtttcgccatattggccaggctggtcttgatctcctgatctcaaatgatctgcccacctcagcctcccaaagtgcttggattacaggtgtgcgccactgcacccagcccacaaatatatatttatttctttcacaaacattgaggccatctgtacatgtggttttgtaatctgccttttccccaacttgccarttaattatgaatattctttcctcttaataaaatatttctacaggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattrtttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtrtaataaaaacatatatatatatataaaagaaatgggacagattccttgaaacacacatgaaatgagttacgcttttgagattctccttgaagaagcttcttcaactgtgctggttgggttaagcaccgatagtcactcagaggatctgcttctgaaataagggatctactaaaatgcatccctcagatgaaatgcagtattccctttgcaaatctgcatttcagactgttgacatgacgtcttaacgtcaacatgtttcttctgtcttttaaggatgtggataatggtaagaggatcaccactgagggagatgcatgatgttgtgctacttgctattgcccagaacttactgtaacaataatrtaatatgctgggggtctgcgaagtgctgagtgctctcatactgcattttacatttttaacacaacttcatggagcaggtattattatcatttctgtcttacagagtaagaaatgggggctctgcaaacttaagtaactggcccagagtgacaaggtggcaaactgacctgtgtctgctgtctaagaccaagtgcttaaccaccatgtagattgacactttgatgtggtacagcagtaaagtttagtattagtgaggagagggcatctcttttactatagtttattgtgaatattctttcctcttaatatcagtatttctacagggtaattttaacacctgcctggaattgcattgtctcaaaggacccgtttcattcaatggtcccwttgaatgaaagtcaagaaggcttgctataagatctaaactcttaggggggttacctttctattatcaaataacctttattgttattggaaaaagtcagcttaacagcattaaaagcaatttcaaaaaaaggaaacgaataccatatgatccagtaattccagtcctatgtatatctccaaaagaattgaaaacaggcccctggacagttatttgtacatcagtgttcatagtagtagcattgttcacagtagccaaaggtggacccaagatcccatcaacaaatgaatggatagataaaatgtggttcatccatacaacaaaatactattcagccataagaaagaaagaaattctgatttatggtacaacatggatggatcttgaggacattatgctaagtgaagccagacacagaaggacaaatactggatgattccacttacatgagtacctagattaggcaacttaatattctacagaaattagaatagaggttaccaggggctgttcagaggagggagtgggcattattgtttaatggctacagtttatgctggggataatgacagtgttttgggtacaggtagtggtgatagttacacaacattgtgaatattgatgataccgaattgtacactgacaaatggttaagatgataaatattatggtatgtatgttttaccacaataaaaatgaaaaggaacaaatatctctatttttctaacccaactgaattccttttctctctgtgtccacagtcatacattttgcttgtatactgtaattattatacaaatacttttattttgtatttgaatttctttttactcagtctataccacaactttcccctatagttagcatggccttcatatttttagtggctaaagagtatttcatcatgcagccagatcacagtgcccacagccctccccatgttattgaatatttaggttgtttctaggtttttatgtttatagacaaaggctgcctttcatgggcttttgtctgtggaatccctttgacatcaggaatctgctggtaggaaacaaaggctcctcccagtggcttctcygtaaggagaatccacttaaaattaaaaaaaaaattaattttggagtagatagtacgtaaacatgrcacaattttttttgttttttggacaaggtgtttgcagtgaaagcatttcccttttttgtcccctacctgcccatttcctctccctggaggtgacgtttgttgccaggtaaagagagacagggttgaaagccgcggtagaaaataggcccagcctccgcggttacttccgggcctctatgtaggcatccctggtgcaggtggctgagtgggcagcgggagatgatcggaggatgggctcctgtgggagattccatttctgactctgctctgaaggtgcagggtgtgcctgttttcttcccttcctcatccgtcctcaaatgctgcaacttagtaaaggtcagctctccatttcagttttcctctttggtatgtaaggctgtgtcacgggaagatgtttccttctgagtgactgatttaaaaaacacaacaaaacaaaaaaacctctttattgagatataatatacataccgaaaagggatgtatcctcagcacatagcttcatgaacttttacaaactgaacacatcttgttaccagcacccatataaaaaaactgaatgtgatttccacttcagatgaccccttgaagggctttttttttttttttttttttgagatggagtttcgctcttgttgcccaggctggagtgcgatggcgcgatcttggctcactgcaacctctgccttccgggttcaagtgattctcctgcctcagcctcccaagtagctgggactacaggcatgcaccaccacgcccggctaattttgtactttttttgatagagacggggtttctccatgctggtcaggctggtctcaaactcccgacttcaggtgatccgcctgccttggctgcccaaagtgctgggattacaggcgtgatccaccgcgcctggcctttttttttttttttttttttttgagacaaaccctcattctgtcgcccaggctggagtgcagtggtgtgatatcggctcactgcaacctctgccttctgggttcaagcgactcttgtgccccagcctcccgagtagctgggattacaggcgtgtaccaccacacccaactaatttttgtatttttagtagagatgggttttcaccatgttggccaggctagtctcgaacctctgacctcaagtgatccatctcggcttcccaaaatgttgggattacaggcatgagccattgcacccagcctaagggctcatttttaagacaacaacaaaaaactggagaactggtaagataaactgggaagttcatgtgcgtcacagaagagctgaaattcttgagagcactgagtgtgtgcatttctcagctcgattttggagtgtgccttttgtgaactcattaraaagcgtaatggcaaaagagcaggtcctctcgacagcacttggagaggaagctgggcgtcatgatagtaacagttttcccttctccttcctttcttctgagcagttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacgtaagtctcttaggatgcccytctaaggaacagcctctctaactgtctcttggaggaggcactggttaaatgatggccagtgtgcttctgggatccaggttgactctgaaactgctgaagttgaaaacattggtctcagcaatggttctgctgtcaccatggggcactgttcttcaagctatgtgaacttagaattgtcattagaaggaagaaatgattccttgggaatggtgactgaaatggttctagtcattccttgagaatacagagtagagaagggtcaccttgtcatgttggtattggaagatactgcccagatgaggagcttcgcctgcaacagttagggaggtgttttgcgaayatttgaattaaatacatggtaaagatgttagtttgtaatatgtttttagtatatttttctccatctattagatttaaaaaacagattagaaattaaatgttaaaaatatrtttgaaataaacttgaagtattaaaagaagcctaaattaaacttcttttgagacttaatctgtataattattttcttgatgtgtttttgggaagttttccatcttttgagccagcaaatactagttttattcattctttctaaaacgagccaggctatttttggatatagtaaatagtcctggaattctacttaatctgtgcttttacatgaattgccttttttttaaaatcaagggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacaggtgagtgtagccccarctgcctcttggactcctccctgagtggtgctgaccttgcaggtcagtcctcccaagtctgtagtttgtctggttttgtgtgatgtgcagtgatggacattgagctttccgaggcatcctgttagcttatcggtgctgtctcgatgccctcatcatttctgcattcaataaatatttattgagcatataccatatgccagtcaagtccttgccttcttggaacttttcgaaggaggaagtgggatgtttacctagagtgctcaggaaaggcctcaatgacaaggtgacttttgagcaaagatctgaatgaagggaaggagccagccatgtggatatcagggcatgagaacattacaggcagaggcctgtgcagaggggcctgtgcagcatcaccactgtatctggaggctggaggaagagcaggaggcaagggtgggaggagtggacccgcaggaacaggaggatataggtgggaggtgaggcctgagtggggctgagccaggatgtggatgatatctggcattggtttgtcttttgtgctggagaagatgaaaagtttattgaaatgatgcccagcctttgcatccttcttgatcctcacctatctcacaactgaaaatgtgtgataaagagaagagccctctgtgtaattgaggatgctttcagggcagcccaggaaaggctttgcagacagtggtgggcacttctgctcacagtgctgactgtggcacctttatcactcagcacccgtgcactactcattttctgcccttctcgctcctacctcttccctttttagcccaggccattcagatatgttcaggctgatttggaagtgatggtctcatgggatcagcctccctggtagtataggagctccagccttgatggcctctggcttttcagtggtgagtggggtggccacagaaatccctgcagctttgggtcacttctgctccatcccacctggtctagacacccatctttgatatttgggtgcctttcattgctgatatttatcttagctatagttatttgtagcctatagcaagagaaaaactgtatctgagcatttatgactgggtgtgggtggaacaggagctgtaaaagtgggtgcagtgttcaggttacctttccaggccctgggtggcaaatgtgggtgttgcactaggtgccttggtagagcttctcctgctctaaaattctgtgacattcaattaatgataatactgtcctccagttgtaatatggagttttctatttacatcagtttgatgttagtcctcagtaaaaatctaatggccctcagatagagacaaataacactctattttgaagatgaggaaactgatgcatcatcaatggatgatgcagtatgttatgtgagtagagagtgtcttgaacttagacttagaaaacctgggatctagttttggcttcaccacctgccatgtcatcatcagccaattacttaacctctctgagcctctgtggatttatctgcagatgggacagtataggcctcacctgtctcagaagtatcatcaagagggccttggctgggctggtggctcacayctrtaatcccagcactttgggaggccaaggtgggtggatcaggaggtcaaaagatcgagaccatcctggctaacatggtgaaaccccatgtctactaaaaatacaaaaatcaactgggtatggtggtgcatgcctgtagtcccagcgacttgggaggctgacacaggagaattgtttgaacccrggaggtggacgttgcggtgagctgagattgcgccattgcactccagcctggtcgacagagcgagactccgtctcaaaaaaaaaagggggtcctcatgatgagatggtgcaagtgaggaggttgctacttctcacaggatgatacagctgactctcatggagccctggtctcttccaggcgtctttcttggtgcctgacatcattgttcaatttactcttcaaagagtcctgcagctgaggctcagagcagttgggtgactgacccaagctcacacagtttggtgttgcccaatttagggtcagcccctgcctcttccaccacatcacccacccaccttctcatccccaggattctgctactccctatttccatgtttgcaaaggcaaaagtcccggaatctcatgctgtgctgtacttgctttgcagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagartggcactgagtatagaacggaagtcacgtatttgaatttttctacctcgtacaacatcagcatcaccactgtgtcctgtggaaagatggcagcccccacccggaacacctgcactactggcatcacaggtgggctacaaggcaggggctggtcagttggcactgtgatcactcctggagcggctgacccacagtgggtctgcacgtgtggactagaaatctgtttttgtttttttatttcccctaaaatatttgcttttactgacatagactggtttctcattctatagaaatcaatctaaaaaagcagagtaagaggggctcattttttacattctaaaagattccttttctttacagcataactcattgcctcattgccatgttttcttttatatttttttgagatggagtcttgctcttgtcacccaggctggaatgcagtgacgcaatctcagctcactgcaacctctgcttcctgggttcaagtgattttggtgcctcagcctcctgagtagctgggactacagacacatgtcaccacgcctggctaatttttgtatttagagatggggtttcaccatgttggccaggctggtcttgaactcctgacytcaagtgatccacccgccttggcctcctaaagtgttgggattacccacgtgagccactgcgcctggtcgtcttttarcccacatctgttggtggcttactgtgtgctatggtgagggatactatggtgagtaggggcgacagggcccctggagcataggactgagaagagcattgagagggagaggatttccaggtctggtggtgggtgagctagcatgctgctgccarttttgcagcaaggacctggggatggaccttctctggccagctacagggtatagagctggtgggaaatgcaggagcctgtgctagcagttgaccattaacatgggaaygccacctcccagcgggcactgctgccgcatacttgcgaggttgctgaagcttgtagttyagagcaggaccatcccactagatgtgcaatgtgagcctcaggtataatttaaagttttctagaagccacactgaaaaaaaagtgaaaaggaatagcygaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcayatctgaatgcaaactggtcacctctcaggggcttggcagcygcatgtggctagagggctgctgtatcagcacaggtttagacaattatgttgtggttgttttggagttcagatttctgtctccttgaatcttgaatatatataataatgagaacaggctgggcgtggtggcttatgcctgtaatcccagcactttgggaggctgaggtgggaggattgcttgagccaggagtttgaaaccagcctgggcaacatagcgagatcccatctcatttattttttaaaaatatataaaaaaaatgggaataacccaaactgtatgtgtgagatgaatttaggtagagagagagagtgtgtggagtggatcatctttaattcagtgtgttctttcttttgtgttagttcagagagtggctccataccctggcttggaaagggggggtgtgcacaatcatggaggccatccatggagggtcctgtgggggcttttctggtttctgggaagaggatctgttgggtttctctaggtggtatttgagaccaactctgggaaaaatgtggggactgtttatgaagaacacagagaagtgctgtgcccaggtctcagcagaaagtgtgttctctcccacctcatctgtgattcttctccttggacatttgctccgtctttgctctcagctgaccagctgatcctggggccaagccaagtccatgtggtgtcattgtgcagctcccaaggccacaccttagagttccaccacagtctctttctcactctccttcttccaccccagatctcaggataatgaacccggctcatcttgagtcatatgggactgggggagaggacaagggcaggttagcttcctcatgcaaggatactagcttcttactctaatgatggtttcttttactgtgcaaaaccttttcagtttgatttaatcttgcttgtcaatttttgcttttgttgctgtgctttttgtgtggtatccaagcaaccattgtaaatactatgtcaagaagctcttccccaatgtgtttttttttttttttaaacaaattttacagtgtacagctttaggtctaatgtttaaggcttgaatctattcagagtttatttttgtgtctggtgtaagatagaggtccagttttattattttgctcacggatacacagttttcccagcaccatttgttgaagaggctgtcttttccccattgtgtcttcttgacatccttgttgaagataagttgactgtatatgtgagagtttaattctgggctcagtattctgttctatgggttgatgtctgtctttatgcctttaatatactgttttaattactgtagctttgaataaatatatcttgaaatcaggaagtgtgaggcctccagctttattctttctcaacgctactttggctattcctggtctttgattgttccatgtgaactttaggattttttttttatattctgtaaaaattgccattgggattttgatggagcattgaatttatagatcgctttgagtagtgtcaagtcttccaacaatgtgaagtcttcyaatccatgagcatgggatgtctttgcatgtatttgtgtatttgtatcttctttattttatcgatgttttgtggttttcactctacaagtctttcatctccttgattgtattctaattatatttcaatcaatctgttaaaaaataaaataaaagcatgtactgttcaaaacaacaatagcaaaaccaaacaaggctgctgggtgcctgccctggggatttggctggatgccctgaaggggtcattgtgagctaggtgggtttcccaggatctgctgtctctgctcctcaccagtttccttccctgccttttgcttctggatttgctgttttgcacgagcccagcatgtagcttccagagtaagatcttgaggaggttgctgaagcatgttctctacctaatgtgttgctttggttttcaatattgggtgatcatgttttgttttgttttgttttagatccccctcctccagatggatcccctaatattacatctgtcagtcacaattcagtaaaggtcaagttcagtggatttgaagccagccacggacccatcaaagcctatgctgtcattctcaccaccggggaaggtaaggagaggcctccgtgggttaaacagcccatgagtgatgcagtgaccagagctttctctgtgcccactgaggcatgtgagtaatgcagacacacgcctgtcttctcactgcagccyatgctgtgtactcagacagagaaggagggtgaggtatttgcctgatggttgacaaactttctggaaagggccagattgccaatattttaagctttgcaggtggtatagagtctgttgcaagcattygactctgccattgtagtgtgcaagcagtcacagaagatacagaaggaatgagtgggaccattcccactagatgttatttaccatggcaggtggatttggtttgtggcccataacttgctgatctgtgatctaggtttttcttctcttttacctcactgggccttttaggtggtagaatattagttttaaccaactctgtctctctctctcactctacacacgtacacacatgccatcctcagaggatgactttcctttgaaagaaaatagaaaaagatttgcatttgctagtgggaatttgcagagtatctccttagctgagagaagaggtggattaaaagctgcttttccttaaagggctctgttacattcttttgtggtaggaaaggaatcattcgagagtctcttcggtagctgtgtttgagtgcttgcataaggcctagatttaaaagcccaagttttgttgggggggttccctcctccccctcccctcctccccctcccctatcatcatcgtcccattgtcctccaccctcccctctcctcctcctccccttctccccttctccccttctccttcccttccccttccctctttctttcttttagagacaagatctcaccatgttgcccaggctggtcttgaactcctggactcaagtaatcctcccaccttggccttccaaagtgctgggactagactacaggcatgagcctctgtgcctggtctgggagattctttatgcatgaataatgcagtgtttcctctgcccactctctcctactgtggtgctgtcctcatgtccttgaggaggatagagaccaaacacactgtcggggttagggatctgggaggatagaaatttgctggtgccataacctgtggcaaaatttcaaaaagtgaggttgaaatctctatcttttaattttgggtctgtttccagctcttagtcattttgctgtgatgcttgtcagcaagtcccattgaggaaggccatgttgcatagcagccagactgaccagtgctggcctgtgattagatgaaaccttgggctctgagcccgatgccctggattgggaacccaactctacctcataggcagtgtgaccttgtgcctggtcctgttagccttttgtaccttcgttttcttgtctgtaaaatggagacaataagcttatgtgatgggattcatggggatgaagtgagttactgtaggtgaaacccttagaattcaatgtaagtcaaacctggcacagagagatacttgagagatggttgctgatcactatcacccaacatcaccaccatgtagatatgcaggagaagaaatctctctgccatcactttcttatgattctccttctgtgtacctttcttagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccggtaatgtcttctggttcttactctttgggggctgagcctcatgagcataaagctctacatgcctgcggtcagacacgtctcagggacctctttttgctctttgttatcccacagggcttgtgtggctggcttcaccaacattaccttccaccctcaaaacaaggggctcattgatggggytgagagctatgtgtccttcagtcgytactcagatgctgtttccttgccccaggatccaggtagggagaagacaacagtcctggcactggttcagtggcattttgctccacgtgtccatagaaggccagctgtgtacatgcctccctcagaccttcaggagggttggtgtgcccagctctcccctcccagaggttgagatgtcactgggtcaccgggcttactgggcttcctcctccgaggtcccacagcctggaccccacactctcccttctctaagtgccagttgttcttccaatctgcaaagattattgactccccttatctatgtgtggtcacttgtgggcccatatgccaggtgcacagtttgacacattgcattgaatccttaaatagtagaatcagaggaagccacataaattgtcttgttcaatcctctgtttatttttcttcataattttaattatgtttattgatttgtttattttattttatgttttttttttttttttttcagacagagtcttgctctgtcacccaggctggagtgcagtggcacgatatctgctcactgcaacctctgccttctgggttcaagcaattcttctgcctcagcctcctgagtagctgggattacaggtgcctgctaccatgcccagctaatttttgtatttttagtggcgacggggttttgctctgttggccaggctggtctcgaactcstgacctcaggtgatctgcccacctcggcttcccaaagtgctgggattataggcgtgagccaccatgtccagcctatttattttatttttgagacggagtgttgctctgttgcccaggagtacagtggcatgatcatagctcactgtaactttgaattcctgggctcaagggatcctcctgcctcagcctcccaggtgggaccacagttgcttaccaccatgcctggctaattttttgtagagatggggtcttgctatgttgcccaggctggtcctgaactcctggcctcaagcctccttccaccttcttccaaagctctggggttacaggtgtgagccactgtgctctgcctgctttttggaagtgagacttttaaggcctagagaggggaagtaacttgyccagggttacacgatggctttagaggcaggcctgaaattctggtcttggacccttgttaagtgcttctaccctttatcacatagacctargtgatacaggagcttcagggatccaagaggggtgcatcccctaccttcaagccagaggctaatggactggctggtttgttagtttgtctgcttttctttcctagttggtggttgttgggcgcaggaaagaatgcctgccccagaagcaaagtttagggagtccccacatccttccccggtaaacaaatgggtttcctgtcacctgagcatggatgctgctgtaggtacctctgctcatatgtgggtgctagtctcaaaatgtcagaggtggcagraaaaatatctgaaaatccagcccagttccctaaatttgcagttgaggagacagacctggagaggaacagtaactttctcaagaccatccaggtagtagtggattgggaacaggaacctggcttctgcatgcatagactagttttaggtccaaagctatttaactcccttgtgtgtgtgtgcgcctgtgtgtgtgtgtgcatgcatgtgtgtgtatggtatacacactttaactctctggtgttagggtcccaggccagtttttagcacattgtgtggtctgcatgaacacctcttgaagtgtctcccatttggacttttctcaggtgtcatctgtggagcggtttttggctgtatctttggtgccctggttattgtgactgtgggaggcttcatcttctggagaaagaagaggtgatattgcttatgctaataataatactctggtatttaaggaagctttctattaaggaacatttcaaactttgacagattcagaaggaatgatatgatgagcgccatgttcccttcacccatagtgttctgcatttggccagtcctakttcctctgcgcccccagctgggcgatgttaatgtgctcccagctgtcacatcaggccactgatagacgccacagtgtgggatgctactttcaaatgatatgttcttgtttacaagtcagtttcatagtattatgatgttaagagatttcatttcagaggtagctaagtttgaacaccagctctgtctttgaccagctgtttaggaagcttagccttaatgtcctcatctatgataggaggataatcattgtgcctaacttgtgaagctgaggaggattgaataaataaggcacttctcagtgtcttgtgccttgtatgctattactattattttatctgtacaactaccctgtgaggtcattaaatggtaaaagtagcagccctgttttgagtgctcaccgtgtgcctgcatctgtgctttctgtgaattatcgcatgcatgaggctctgcgaggcaggtccagtaagtcccttccaaggatgcagaagctgagtcaggaagtgtggaaatagaacttgaacctggtccttgcacttcatggcacgccctcttgtctgtgtagtgtgtgaagcctgtgtgtgttagttgggatttctttgctgtaaggtgctgccaaccagggaatctccatcctgccttaggggtcytcatgcggcccaggccggttccttgtgctgccaccctgccctgttggagtgacaggcagagctcatgctccagcttttaggttaggttctgtttttttttttttgagatggagtctggctctgtcccccaggctggagtacagtggcatgatctcagctcactgcaacctctgcctcctggttcaagtgattctgctgcctcagcctcttgagtagctgggattacaggcaccgccaccacacccagctaatttttgtatttttagtagagacggagtttcaccatgttggccaggctggtctcgaactcctgacctcaagggatctgcccgcctcagcctcctgaagtgttgggatcacaggcgtgagcccctgtgcctggccagattaggttctgattttggrgggggaaatggatcagtcagtggctggataaaacagttttattgtttcttgttaaaaataagagtaatacatgcttatggcaaaaaatatagaaaagaagagcaaaaataaataggaaatctgcaatcgcagaacccacacaaaactactcttaacattttgatgtgaccaaactcacacacaaatgtgtgcacacacatggaatcatgttacatgttagaatcaagcctgctttattcagcttagacattgttggcagcttcatttcatcacaattttttttttttttgagacagagtttcgttcttgttgtccaggctggagtgcaatggcgtggtcttggctcactgcaacctctgcctcctgggttcaagcgattctcctgyctcagcctcccaagtagctgggattacaggtgcccgccaccatgcctggctattttttttgtatttttagtagagatggagttttgccatgttggctggtcttaaactcctgacctcaggtgatccacccgcctcggcctcttaaagtkctgggattacaggcatcagccaccgtgcctggctcatttcatcatcattttaagtggctacagagtattcaactgtatgacagtaccatgatctagttaaccaatttcctaggtgtttccaagttttttttcttggccacagttacttatccttgtgcctaaatctttgggcacattcacgattatttccttaggctaaattccaagctaggcaagtgctgggtcagtgggtatgcgtgctttcagttttgatacatactgccaaattaccttccagaaagtttttcttaaataccaatgcagagttgagtcaacagtgcaggagtgtrcagatgcctcaccaacttgccagttccggatctgatatgttttttggtttattgcattcatttatcagaaaagctttctcaaaaacaaagtatgaaataacaagtcttgctttacattaaagtaatgccactgctatatatttgcaaggaagttcttaaaagtgacttggatatgatttttttcattcttttagatagtacaaaagaaaataacttcacaaatttgtaattagcatttgcagcttgggtcattaagtttagtattagggggcaggatttggtgtcagckgtgaactaatgcctgaggaaaaggtgtaacacctttatttcatagatgacatcaactccagatacacaagggaaaagcacaggaaggaatccttttttgtctaatgggtctcttttctcttaaaacaggaaagatgcaaagaataatgaagtgtccttttctcaaattaagtaagtctctcaaattatgagctttattttaaatcctccaatctgttcggtgactatctataaataatttttgatggaacttgctgtcatttttcctgattgrcacattttgaccatgaccatctggaagtttttgctagctctgttttctgcaaggaatctatgttttattagtctcctgaagytggcttccttgtcatgttctactcttctaccaataaatacggatttcttgattaaaaaaacgtcaaataggttatcaagatccaggggagagaagaacttacttaaagtcacaaaaccaattagttacaaagtagggtctagaaatcagatttcctgaatcatattktagtgttttgtgaataatagtactctgaccccctcttgccaaattatrccctgggttttgttgttttgggaagattgtttactrtcatttctagagtatgaatgagtctttctaattgcatattttttctttccctttctatcrtgaagacctaaaaagtgagtaatctctttattttttttaataacttgtacttttctattgaatatggacttcactgaatgtaaaaaatcctgataagttttgttttcttagatctaagttaatcagagtggagaattttgaggcctacttcaagaagcagcaagctgactccaactgtgggttcgcagaggaatacgaagtatgttgctgtaaatactgtttttaattgtgtcaggttccaacccaagctgggatcygaggggagttggtggatgggtggcaggtagctgaaagaacactcgagggactgtaggcagttgggacatggctttattctctctcctacagagtcagcagtgcagttatattactcacagacaatagtggctcaaagccaggtatgaactcacacaaacaggttacattaaatggctatataacgcaaggggttgttgcgctccaaaccctttgcgtcatactgtcctggatgtctacctyggactactcctgactgaagcacagccactttccttagaaattggcttgtttttcctgaaagttagaaaactgttaacagaaactaggaattcaagtcagggaactgttagccacaatacttaggaagctatatgagctggaaagaaaccaaatgggcatgtagaggtctggggcttgatggcagtgtggcctaggatggcttgtgaggctcacttctgaagccctgcacaaggamtttcttggccagtgtctgcctttcagttccccatgctgtgctccaaccagcccaggaaccagccctgctcagagtgaccatgcacactcgtcctcctgtgctgccctgtccagcatctctgcctttgctctcttgaaatcctgctcagcactcagcacagtgcacatgctgcttcctccatgggcattctgggatcccattaggaggacttgagttctgtgtgctcagactrccttgtttcccctgttgcttgttaccaatattcagcatttctttaattctgcctttttgtaatgttagttttttctgtgtacagtacacctctcctccaggttgcaactgcttgaaggcaagggttatcctttttcctatattctaacctttgtattagttctctaggctgccataaaaaagcaccacaaactgggaggctgaaaacaacagaaatttactgtctagaggccacaagtcccaaattaaggtgtgggcagggtcacactcccttctaaacctctgggcagcgcccttccttgcctccgcagcttctgggagccccaggcgtcccttggttttgtggcagcaacactctgatgtctgcctctgtgttcacatggccatctcccctcatgtgtctatgtctctttgtctcttttcctcctataaggacactagtcatatgggattcagggcccactctaatctagtatgatctcattttaatttgtttacatttgtaaagagccttttttttttatactttaagttctaggatacatgagcacaacatgcaggtttgttacatatgtgtacatgtgccatgttggtgtgctgcacccattaactcatcatttacattaggtatatctcctaatgctatccctccccccaccccatgacaggccccggtgtgtgatgttcccctccctgtgtccaagtgttctcattgttcaattcccacctatgagtaagaacatgcggtgtttggttttctgtccttgcgatcgtttgctgagaatgatggtttccagcttcatccatgtccctacaaaggacctgaactcatccttttatggctgcatagtattccatggtgaatgtgtgccacatttttcttagtccagtctatcattgatgkgcatttcrgttggttccaagtctttgctattgtgaatagtgctgcaataaacatacatgtgcatgtgtctttatagcagcatgatttataatcctttgggtatatacccagtaatgggatggctgggtcaaatggtatttctagtttcatatccttgaggaatcaccacattgtcttccacaatggttgaactagtttacagtcccaacaacagtgtaaaagtgttgctatttctccacatcctctccagcacctgttgtttcctgactttttaatgattgccattctaactggtgtgagatgctatctcattgtggttttgatttgcatttctctgatggccagygatgatgagcattttttcatgtgtcttttggctgcataaatgtcttcttttgagaagtgtctgttcatatccttcgcccactttttgatggggttgtttgattttttcttgtaaatttgtttaagttctttgtagtttctggatattagccctttgtcagatgggtagattgcaaaaattttctcccattctgtaggttgcctgttcactctgatggtagtttcttttgctgtgcagaagctctttagtttaattagatccmatttgtcaattttgtcttttgttgccattgcttttggtgttttagacgtaaagtccttgcccatgcctatgtcctgaatagtattgcctaggttttcttctagggtttttatggttttaggtctgacatttaagtctttaatccatcttgaattaatttttgtcagtttcagctttctacatatggctagccagttttcccagcaccatttattaaattgggaatcctttccccattgcttgtttttgtcaggtttgtcaaagatcagatggttgtagatgtgtggtattatttctgagggctctgttctgttccattggtctatatctctgttttggtaccagtgccatgctcttttggttactgtagccttgtagtatagtttgacgtcagctagcatgatgcttccagctttgttcttttggyttaggattgtcttggcagtgcaggcttgtaaagagcctatttctaaataagatcccactcataggtattgggggygagaaatccaacatatctttttggggcacagtttaacccatatcacctctacatttccactttgttcttttgctaccaaaacaccacgggtttggtctaggtcctgctcctcacctttacagaaagccaatcactgagatgacaaatattgcyggggaagaaagctttaatcgggtgctgcagccaaggagatgggagctgaatctcaaatccatctcgctgactgactaaaaccaggggtttatacagcaggaaagaaatgtaacaatgtgtaagaaaacaggaactaggggctgggcatggtggctcacgcctgtaatcccagcactttgggaggccaaggtgggtggatcacgaggtcaggagatcgagaccatcctggctaacatggtgaaaccccgtctctactaaaaatacaaaaaattagccaggcgtggtggtgggcgtctgtagtcccagctactcgggaggctgaggcaggagaccgcgccactgcactccagcctgggygacagagcgagactctgtctcaaaaaaaaaaaaaaaaaaaaaaaaaagaaaacaggaagtagggaggggcaaggaggcatctggtgcagtgatctgactagtttcagttctttgttactccctgaaggycctttcctgagaaaggaactcagataaaacaaatacaagtttcaggctttaatagcagaagggtaaatttctatgtttattcaaaaacaacttgtctatgggactgttgggctggtttcactgtcatatgctatgctaaatatgaataatatttgaagactaaataaatgaacacctcatttgttttgttttcaggatctgaagcttgttggaattagtcaacctaaatatgcagcagaactggctgagaatagaggaaagaatcgctataataatgttctgccctgtaagttattttatctacagcatcttctctgtgttccatcagtggccatcacatctctaagtgtagaggggagggaatcagtgatcctaagtaaccacttccacaaccattcattagtcacctacttccacaaccatccattattcacctactatgtgctaagcactatatttaggtgcattctcttaaatcctcacaacagccttatgaagtaggtagtagaatatttgttttgcagatgaggaaaatgcacagagtggttaggtgatctttccaaggttacacaggtagtgacgggaaaactcggctttgtactaggtctgtctgtctcagtaagggaaaaggccagagtctgtgttcttaacccctctgtctcacaactatttatttcarttctataattctggaatgaaagtgagcagagggagacggggagtcacactctctgtgtccagacacatgggctgagtgaattccacagctaagtatgacttatatttagctcatttcctgtttttgagaattaacaatgtctgcatcttagtcaacaggattacagcaaattgagtttaaaataagaattatttattacatcaaaccattagatgaaatgtaaataattctccattgaaagttccttgtaatctctcttttgggtggggattagggcacagagaggagcataagcagattgtagccatgttctgatggagctgaaattgatagactttgcagataatttttacatcaggacgtcatcatctttattcgaagccgtgtttttcattcctggactaaaacattaagttctttttaaattcagcattttctagttcttgggttctttctctccatttatttccttgtacttgacaaggartattggcccatgttctgagggaaatgcttttaaaactaggctgggggtattgcccttgtaagggtaatttgggattattggcccctttttgtgaatgtctgtggagattctcagatctggagtgggagctgggaagtgggtgtttgggtattgttcttattgggaagcctttaggctgagactcaggtcagtactagacttagcattgttatgttattttgtccagaggagggtgaggtagtacaatcagagacrgggaaactgaggtggtgctgcttctggctcakcctgacacttgcagttctaaggttattatttcatctcttaagttgggcaagtttgtgtgtatgcttttgagatgacaataatatttataaaacataattctgtgttttagaccctcctactcatagtagtcttatacattcaatttatacttgaacttggtactctgtttttataacaacttgtttatatgagaatagaggcagagtagaatggttaacctagggacctaccccgtcctagtggaaggggcactagatttgaattttgactgcccctcaccagatatatgaacttggagaagtcacttaatctctgtaaccctcagtttcctcatctgtgaaacagggcagtggcttgtagggtggttttgaggagtaaataaaattgtttagcatattccctcatggtagacacctgaggatgctaatagtaacaggttcattttatgtgagaaggcatctggtgtggttaagatcttgggtcctggtgtcaggctgcaggttcaaatcctggccctgccactcattagctctgctctggtgatcatgtgacttctctgtgccacggtcatatagagtgaccatgaggattaaatgaggtggtctatatgaaatgccacactgtgcatcttcaaagacacaagtcccagttttgccattttgaatttcatttttttttctgttttgtgtccaactttactaaaacatttgcttataatggggaccttttttcttttaatgtcacagatgatatttcccgtgtcaaactttcggtccagacccattcaacggatgactacatcaatgccaactacatgcctgtaagttgggggacggtctcacagcactggactgtttcgatgaaatcttcagtgtgctttgcttctttctgtttctttgaggttgactatgtgctgtttcccatttttagggctaccactccaagaaagattttattgccacacaaggacctttaccgaacactttgaaagatttttggcgtatggtttgggagaaaaatgtatatgccatcattatgttgactaaatgtgttgaacagggaagagtaagtatcttttttagtttttaaaatttaaaattacattaattgctttttattgtggcagaagggtatcttaaaaaccatttgtttctttaaaaaaactcaaacattagcactttattcttataaacttgttttctgtctttttttccccrtaagagaaatgtttaaaaacattctttaaacaattctattttgtcattatcttttttttggacaaatatcagtgtcttctgtttattacgttgctgctggagttagtaaatagcaaaatctcccaggcctagtgcaagatgctgttcacggtgtggctctgttcttcattggccccatgaacacggacaagcccatcatgtctctaagcaaccggtgtcttcatctgtgagatgagggttttcatcagctccatgattttcaaatttaggttgagcactgaacccctcctgcctccaccccaggtttttttttttttttttttgagacagggtctcctctgtcagccagcctggagtgcagtggtgcgatcatggctcactacagctttgaattcctgggctccctcccacttcagcctcctgtgtagctgggactacaggcgtgcaccacatgcctggataattttttttatttttagtggaggcaaggtctcactgtgttgcccaggctggtgtcaaactcctgacctcaagtgatcctgcttccttggcctcccaaagtgttgggattwcaggcgtgagccatcacacctggcctggaaccatttctttaagcaaaatctcagacttatccctggataagcctcagcagcctcctctctcctgcaacgtcctgaaatccctcttctgcttccatcaaagataagattttttttttttagatggagtctcactctgtcgccaggctggagtgccrtggtgtgatcttggcttttgcaacctccgactccctggttcaagcgattctcctgcctcagcctcccaagtagctgggattacaggcaggcgccaccatgcccagctactttttgtatttttagtagagacagggtttcactatgttggccaggatggtctcaatctcctgaccttgtggtccacctgccttggcctcccaaagtgctggattgcagatgtgagccaccgcccctggccaatattttttatagtaataaaattctgcatttccatgaattgatgtgargagaactgaaaaacacatgctaatctaaaaaaatgctgtgccttaggaatgggacttaatgttgctttatgagttgtttttaagtgtaggttcattgcttgaggaataggattcgattccttaagccagtggatctcaaactttagcatccatcagcatcaccaggagggtggttctaccctcagagtttctaattcggaattgcgtttctgccagtttctgggtgatyctactgctgtggcaccagggtgcacacttggagtggtactgtccccaggatagtgggagcccttcaggcatcatttcttttattgttctttaattcatggtaagctagcagatgtttatccagcccctggtatatgtaagatcctgtgctaggggctgaggatggaggagggaaagataacagagcagtaagagatgacgcccatcctcatgttgcttgtgatagagggtgggctccttaccctcttgttgaatcaggagaataggctgtaatagaaataaaagcgtttttaaaatgaatgctgataggctgggtgcagtggctyacagctgtaatcccagcactttggaaggccatggtgggcagaccacctgaggtcaggagtttgagaccagcctggccaacatggcgaaacccatctctactaaaaacacaaaaattagccaggcgtggtggtgcatgcctgtaatcccagctacttgggaggctgaggcaggagaatggcctgaacccaggaggcggaggttgcagtgagccaagattgcaccactgcactccagcctaggcaacagagcaagactctgtctcaaaacaaaacaaaacaaaaaaagaagaatgcaaataagctttttaatactgttgagcccagggccttatacatgaaacattcttataaatctatctgttagacaaacaaaaatgacataattacattaatggagaacatgaagatgaatttaaatggtcttttgttcatctaaaatcaagattgaagttagtcttagtgaccctgggtgaayggggaagggagtgtattttctgcactagattctccatatatgttattttttttctgtaacaaccctgtgaggtattatgatttcatagatgaggtaactgaggcttggggagtttaagaacttgcccacaaggtaggaacaaaaatatacctggtaagaggctgagctgggaatcaactccatgtcagtgtgtatccagatcctgggttgtttctttggaacctgggtctttaaagaaatacagatcccgcagccagagtcagaatctctggaggtagaacccaggcatctctttttaaacaaaacaaggccaggcacagaggctcaggcatgtaatctcagcactttgggaggccaaggtgagaggatcacttgaggccaggagttcaagaacagcctgggcaacatagtgagacccccatctctacaaaaatacaaaatagctgggtgtggtggcacgtctctgtagtccaaactcctctggaagctgaggtgggaggatcacttgagcctgagaggttgaggctgcagtgagccgtgatcgtgccattgtaccccagcttgtatgacagagtgagactgtctcaaacamacamacaaacaaaaaacagaaaacaaaacccaaaacaactcaaacttctcaggtgagtcagataatcaattagctttgaaaactaccagcagtagagcacaccttagaatactgagtgtgygtgygtgtgtgtgtatgtggggggtgtgtgtgtgtgtgtgtatgtggggkgtgtgtgtgtstgtgtgtgtgtgtgtgtgtgtgtgtgtgtgtgtgtgtgtgtdgtcatttgccaaatgggtattcagatattcttggagagcaggtgtttcctggttatttctgttcacatctgcccaccaactttatagaaatcaaagaccccagaatgatttaatttgattttctttattggtgtgtgtatttgtattgcaaccgatgtatatctgaaagccttgggaaaaagtcctcatttcttccagctgtctggggttatgggagaagatgaggtcagtgaacagttgtggtggctactctaggggcaaagggagctggatggggactgtgtcctaggtcaagggacagctgctgctctgctctaaatcaattttcatgctgaaagcagggcctrttgtaggcagatctgatttttaaagagaaaataagtctggatttttatgagaaattttaagagttggcaagaattgtaaattaaaaaaagaaaaaacaattccaacaggtgctgtggtgtgcccatagacccagctacttgggaggctgaggcatgaggattgcttgagtgcaggaattggaggtggtagtgtgctatgatctcatttgtgaatagccaccacactccagcctgggcagcatagtgagaccctgtctctataaaataaaataaaaaaattcgaagggtcaaacaaaacccaactagaaggtctgattccatctctgatgccagttttcaatagccagtctcccttgtgaggttttagtgatggcagatggcatgatctgagtcttcttataaaaatgcaattttgttctagaccaaatgtgaggagtattggccctccaagcaggctcaggactatggagacataactgtggcaatgacatcagaaattgttcttccggaatggaccatcagagatttcacagtgaaaaatgtaagtaagaagtcaggatcagttgagctcatgtaattaccatatgttaatttgggggtgatatgttttaggttgatattaactaatatgttttcctatgcagtgagaaatgttttgctkctttcctttcagaacagaacaatccatatgcatgtatactccaaggcaaccccttgacttttctgggaaatttactttcttgggaataacctaagttattkctgaataaaatgaatcttaagagcatggctctacatcaggaactctttcctttctttccacttccaggtgacttgctcatagattttacagaacaaactgtagccttttggattatttggttagaaatatggcatcaggagcggccacttgctgttaggagtaattgataacagttacattaataggattccagggcatatgcacatggcctyccttcccctcaaaatttacaaaagcaaatccaattaaattgtgcaggcattctaggaagtcaagtttatgtgcyttttttctttttcaaggatgctttgaaaatagaggcagtgccatgaagcagcattggtatctgttgatgggtgtgtgcattggcataactctctgctgtttatatcacaggcctaaacattaggcatrtgctggcttgaagtctgagactatcctaaggaaataatctgaaatgcaaccaaaggcttattcagaaagacgagtctcagcattatttataatagaggaaaactttggaaaccatgcagacatggttttgtagcttttgtagcttttgcagaatggataacttaactatgactcgtctgcttataatatcattattcagctattagaaatgatggcccaggtgcggtgattctaacctgtgaggctaaggtgggaggatcgcttgagctcaggtttgagaccagcttgggcaacatgctgaaactccacctctacaaaaacaaaaccaaaccaaacccaaaaattagccaggcatgctggtrtacacctgtagtcccagctacttggaaggctgaggtaggaggatggcttgagcccaggaggtcgaggctgcagtgaaccgagattgtgccactgctgcactcyagcctgggtgacaaagcaagacccggtctcaaaaaaaaaaaaaaaaaaaaaaaaagataaataagggatgggtagactatataattaccatggggacatggtaggatgtaatgtaagagaaacattctaggagatgaaaatgtatgcatattatgaatagtgcataaaaggaaagccgggaagtatagattcactggagttgaatcttgaatcttttgggtgggttttgggggttgatgggttagggtctagtttatgagattatccttgaagattccacaagtcatggataaagtatagtatattaagtagtaattctttactaattgctgtgtctcaaagggtctggcctcaatatttcagttcctcctctggagatgccatcaaagctgttaccatgatctggccacctaaataatgcagctcacagtagtagaaaaatgtcatgcttatttcttttcttttcttttcttttttttctttttttgagatggagtctctctctgtcatccaggctggagtgcagtagcacaatctcagctcactgcaacctctgcctctcgggtccaagtgattctcctgcctcagcctcctgagtagctgggactacaggcacctgccaccatgcccagctaattttttttgtatttttaatagagatggggtgtcaccatattggccaggctggtcttgaacacctgaccttgtgatccacctgctcggcctccaaaagtgttaggattacaggtgggagtcactgtgcccggcctgtcatgcttatttctatagattttgctcatttgaactgactggcttctccttggttgcctccactgcttggggcttaccttgtggaggggaatttaggatggagttgtccacatcatttttaaaaattgctgttactatgattattattttttattaactaaactccagactttattcagatttcatgtttttccactaaagccttgttttgttcctggctctgatccaggacaccacatggcatttagtaccatgttattttttaattatacaaaatgcctgaatacattttcctttagaaaatcgagaaattacaaacagagctaaagatttcctttgactaccacccctaacctgagcccctttgcccctccacgaagataatactaagtataaccctcctcacttctccctcttcctctccccctccttctccccttgcccgctcccactccctttcctctccctccwccctctccctcctccctctccctccctttttcttcctcttcccccacctccatctctcacagctggtttctgtctttggatcagtacttctggttaaatgtgtgaatgttaactttatctgtgatgaggtcttctagcacctctcccttcactctgtctgtttttcctgttttccaaattttgaatactgcacattcttatcatgaatatacatttcaaaaaatgagtgtcaaagggcagctgtcataatggagatggaaatgcctgcagtgcagatgtaggtcacatgggtacggatgtaggtcacatgggtatggtcattccctggtatgggcataacgagtacagctgagtcagggacaggactcgccccagctggggtgggcttctggtgcttcaaggtatatgctttggtatgaggtagggaaccagtctgtgtaataatgagctctattgtctttcagatgttgaaatggatggttttttgggggagtcctttctcagctctctccaattctaaatatttgcatggtgcttgctagtggcctgtcactttattcacttctctaggggacatagtgaattatgaggccattcttgcctagaaggcactgattatcatggtgtatttgagtaaattatttttggttttattgtcagtgacattcccaggggggctcggggatggggctcatgcagctctaaggaggtgcaggtgtaagaatgtgagttcattattgataggcagctgtggcaggaagggaaggatctgaatgcagaattggaggatgagggacttctgttgcatctgaaatcagtgttgrggaaatgacttcacttctgtgaatctctgctgcctcatctttaaagggggataataaactctccttcttgagcatattgtgagggtttgatgagcaagcactttatcagctgctgtgcaaawgtaaagtttaatttttagtcattacaactcctggttagtactcaggctctgcttgatttcccctgcctttttgatgttgttaggcagcctktctgtctgkatctaaatcattttctgggcttttagatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgaytctggtgcattgcaggtacgcagatggcacgtcacgtgtgacagatttcaaatgtcattatatatttatgagcactttacaaaagcaaagcctaagagggaatgtaataggcatttatgaattcaggaaaggtttggataaggaaccatggacttactccctaagccctgagcttccaaaacaggggttggcaaactgtaacccatggatcaaatctggtcagctgctgtttttgtaaataacattttctaggaacacagcatgcccatttatttatatattgtttatggttgcttttctgctacagtgacagaaagagaccatatggtttgcaaagcttaagatgttaactatctggccctttactgaaaaagtttgccaacccctaacaataagaagttagctttgaagctaaaggaattaatttaggacagaagacaggaggggctctgttgcccagtggggaaaaaatggctaaaatgtgccgccatcctgggttatgggcaacttgaatggaactgagattgaagaagcttgagcaaagggttatatgtgtggcatctgactcaaatgtgagtttgggacttaggccccagtcccaagctagtgctgtctgacttgctgaggcttcaactgagcaaatgtgtactgatcctgtgcattgccctcaaagtgtgacagtgaaggaaagcaagatatatgtacaaatgaggaactctaagagggttgcagtcgagggaacccactgtaataggcttatttctcttttctctcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggtgaggccaagatctgtatttgacattccacccttcccctccatttnnnnnnnnnnnnnnnnnnnntttgacattccacccttcccctccatttttttttttttttttttttttttgagacggagtgcttgctctgtcgcccaggctggagtgcagtggcatgatcttggctcactgcaacctctgcctcctgggttcaagtgattctcctgcctctgcctcccaagtagctgggattacaggcacgcacaccatgcccagctaatttttgtaattttagtagagacggtgtttctccatgttggccaggctggtctcgaactcctgacctcaagtgatctgcctgcctcagtgtcccgaagtgctgggattacaggcatgagccactttgcctggcccttcccctccatttttaaaaggttgcattgtgtcatgcacttgtgttaaaatatgtcacccttccagatctttccagctcttggctgtgaactaacactggatttctttgcagactttaagctgacttggaattaaattacccaatacaagtgacatagtagtactgatgtcagtaatggaactactactgagatagtgtcaggattctttaccttgctgcctctgactcattaaataatcttaggacatctttgaactttggcttccaggttttaaactcataaaactggtattttccagtctttgtttctaagaaggtctgaccatctttaaaataagctaatgaaacaaactcatcaaacattaatgatgtgacrtatcataatgctgcttaaatgttaatacagcaatttatcctcacccagacttgtacattktaaagactatcaattatcatagctacagaagggtggctgaccagcggagaaaaggaacacttaatatcyatggtatagtttctgtactactgctggatttggttttacccaaamtgttactgagaagtgtttttgaggcatgttttcaacagaacatattgcaaagttgctttcctcaaaggggtgaatgttccttgaccaggatgagagcagaatattaattttgtatcaggctatcgtcctgtaccgatttagaactctatgaatatgtgctgtgtttttgagtctagcagggaatgttctagatgcctgggtacattgcrtgctctggggtgagcttggtggttgttgtggaaagagtgaaattcaactcctgtgttggtcaaaagagagattttcttttttctgctataattatataaagtagtatttctcaatcttttatccttttttgagaaacatagaactcttatccctgctactagagtctaatctcttttttatattttgaaaacaatacttattcatatgaaagcatttgacaatatatttttctctcctcttttttttttttttgagacggagacttgctctgtcaccgggctggattgcagtggtgcgatctcggctcactgcaacctctgcctcctgggttcaagcgattcccctgcctcagcctcccaagtagctgggactacaggcgtgtgccaccatgcccagctaattttttttttgtattttagtagagatggggtttcaccatgttggccaggatggtctcgatctcctgacctcatgatccgcccgcctcggcctcccaaattgctgggattacaggtgtgagccaccgtgcctggcctcaatatatttttctctkactcttccttccccaatcctgcttcctggaggtagccaatgtttatagtttggtgtacatctttataagactctttatgtacatctgtaaacacacacacacacacrcrcacacacagtactttgaaaaaattggatgctgttttttttttgagatggagtcttsctctgttgcccaggctggagtgcagtggtgccatctcagctcactgaaacctcaacctcctgggttccagcgattctcctgcctcagcctcctgagtagctgggattacaggtgtgtgccaccacgcccagcaaatttttgtatttttagtagagacggggtttcaccatgttggccaggctgatctcgcactcctaacctgagccgatctacctgtcttggcctccccaaagtgctgggattacagacaggagccaccgcgcctggccagatcctgttttatgtatgttgcttctctgtgattttttttctcctcttataatatcatggatatttttctgtgtcagcttatacccttgtttcctcttttcttcatcactatccacagattctgatatacctacctgaaggatagtcctcatccagctccacctgatcatctccttttaacctcgctcctcggttgagcattacagttgattcttactctgtacagtctcactagccaaggcaatcttgttggacatttgattgttcgaatgtgtgtgtgcattttttcctctacatttcctccttcctttgcccttccctgagactgtggcatttttccttggggaggggaggtgtggagtgtgctcttctggttgagaatcattgaggaaggacatcttgcttctgtgatttcagatttcactgcaatgttgttacctcttgaaacatgttcgcttgaaccgtttgctgttgggtggatggggtttgggagttgggcgggggaatgacctgtttgaaaataattttgggtgctaatttctgggacccatgttcattttctgtctctctctttcgttttyctatcaggaccagtatgttttcctcaatcagtgtgttttggatattgtcagatcccagaaagactcaaaagtagatcttatctaccagaacacaactgcaatgacaatctatgaaaaccttgcrcccgtgaccacatttggaaagaccaatggttacatmgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgyggaaaaccaggaaaagggakctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgrcyccgcttcccctgccccctgtasatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtrtatatatatatatatatatatatatatatatatatatatatatatrcactaagctctcaaaaacagtcattcctatgaattgaggtgtacaaagtttgaatttgtatcaaagatgtaattattatttttaaaaccttttcactatactgctgctgtaattactttgatttttaaaatgtagattaattttttttttttgcttcaggtgtgtatccaccaagaatttcaaatttatgtggatttattttattggtacataatctgtaaacttcttaaggcattaacatgaaaagwttttttctttttattttatattgtggctcaggttatattttgaagatgttttgagtttatcctccaataggcaatgaagttgacaaggttttatgaaggaataaccaagtccctggagtcctgtggctgttgccacagtaatgygtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaagktggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttyacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatatygtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcrcccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattkagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgcttttttttttttttaaggaaaaaatggcctgaaaacatttttttaaagacttacaaataccaaatataaaaaaatgtcaatgcattatgcctttgcttctttctttcttcttttttccttcttacaatgtgccaagcagtttactggcctgcattttacttgggcatccttaacaaaaacacatttctctttgggatttccggattgttttagttttctagggctgttgtaacaagtaccaccaactggtggtttaaacagcagagatttacttcctacaattttggtggctgaaatccagatgtgggcagggttggtttcctgtgaggccttttttttttttctttttttgagacagagtctcactctgttgctcagagtggagtgcagaggcgtgatctcagctcackgcaacctctgcctcctgggttcaagcagttctcctgccccagccttcaggcgcctctcttcgtagcttgcagatggctgtcttctccccatgcctccacatggtcttccctctgcttgtctgtgtcctaatctccttcttttttttttttttttgagatggagycttgttctgtcgcccaggctggagtgcagtggcatgatcttggctcactgcaacctctgcttctcgggctcaagcgattctcctgcctcaacctcccgagtagttgggactacaggtgcctgccaccacacccagctaatttttttgtatttttaatagagacagggtttcaccatgttggtcaggctgrtgtcgaactcctgacctcgtgatccacccgccttgtcctcccaaagtgctgggattacaggcgtgagccaccgctcccggctaatcttataaggacacgagtcatactggatcagggcccaccctattgacctaattttaccttaattacctcttcaaagacactccaaatgtagtcaaattctgttttagtgggggttaggacttgaccatatgagttttggaagggacccagttcagcctgtaacacatattcagggcaatttagtgaagaggaggcttggaggaagtggctgtgtgtcttaagattgtgtgtgttcccagaaggttggaggtatgagcctgcaggtggatggatacccagttggttgggggtgtgttatgatatagttagctctcctgggctttctgcttagggacagcgcttgggctgcggataaagtatccatcatcttcctgttttgattcaggccaaagttgtcccagaacttttctgcccacagtgttggtttagaggaggcagggagacactgtattgctgacctgttatctgcatacttaaaaaaaaaamaaaccaaactaggctaccctgcaaaatagcacagcattctctgctcctagcacttagtttgataaaaactaccttacccaggtatagcctaggaattgagatattgtgggaaagaaaaaccgaatgatcacctgtggttttataaaatgtaaagcttaagtgagaaaacaaattcatagaactataaacagagaacaatcccaataagaattaaataagtgcatagaagaaaagaaacacaactctagaataatataatagtgggattaggagtggattttatttttatattcacctgtttatagtttctaacttctcccaatgaatatggagtacttaagagtaactagtttaaaacttagcacttttccctccttgcctcaaaaaagtgaagctacagtatagttttaaatttactagtcaagttacaaaattcyttttttttttttttttttttttttggagacagagtctcgctctgtcacccaggctggagtgcagtggcacgatcttggctcactgcaagctccgcctcccaggttcacgccattctcctgcctcagcctccctagtagctgggattacaggcgcccgccaccatgcccggctaatttttttgtatttttagtagagatggggtttcaccgtgttagccaggatggtctccatctcctgaccttgtgatccgcccgcctcggcctcccaaagtgctgggattacaggcgtgagccacgacgccyggccaagcttccaagttctgatagccatcccatcccttctggggtttcacagctctatttggggctgaacgtggcagatctctggggcctccaacatgagagcytgggctttacattcctgcaggcaggtgaagcctcctgacccaaaaggtgagtagtgggcccctgttggggccagcagttttggatgatgccactagatggcggcagagaactgggctgtggaagcaatccttggctaggctgtggcagggcagtggagcacataggattggaaaagaaaccaggaggtccgtaaggcaaggctaaaaaccagcaacagggcgaaggaagcgcccttgccagcagctggcagctttccgtataatttgttagataatatgttcatggtaaaaaaatttaggaaaagaaggaaaataaaaaaatcctatgttgtcaccattcaacaagatgtcccccaataatcctcccgcctggtattcacatttttgtgtagcccctcctccactgtagcagggttggtctgtgtgactggtagattgcagagaggtgatggcatcccacttctgagataaaactgtgcagtttctctctcgctgtctctctccctccagcccccctcccacggcactctctccaaaaccagctggcatgttctgagcagccttgagagaggcccacgtggtgggcttcttctgaacctcctgccaacagctacatgagtgggcctggaagcagattctcaggtcagcctttggatgacagtagccctggccgacagcttgactgcagcctcctgggagaccccaagccagaacctacccagactccctgacttgcagaaagcatctgagatgataaatgtttactgtttcaaactgctctgttttgggataatttgttacacagcaagagataactaatatgggctaatatatcccaccacataggaaataccactgttaacattttactgtaaataattctgtaacctttagaattctcacaaacaccacacacacacacmccccatatgtgcacacatgcatacatcttcatcttcatgtatttgctttcatctttttgcaaaactggaatcaaacatgttcatatttctttttaagattaacatatttctttgagtaatatttctactgaagcgtaatacagacagaaaaatgcactaatcataggttggctgtttgaataattgtccaaaaatgaacacacccatataaccagcacccaaattaaaaagtatatacgaccagcatgccataagccaccttggtgccccctttcagccacaccctggcaaagctaaccactatcctggctgctaaccttttaagttggttctgtgctcaattttttgaaacttgcttcttttttaaaattaaaaatttttatttttagagacgaggtctcactctgtcatgcaggctgcagtgcagtggcactgtaatggctcaccgtagcctcagactcctggactcaagtgatcctctcacctcagcctcctgagtagctgggactacaggtgcgtgccaccacacctggctaatgaaacttgctttttttttttttgagacagagtttcgctcttgtcacccaggctggagtgcgatggtatgatcttggctcactgcaacctctgccttccgggttcaagcaattcttctgtctcagcctcccaagtacctgggactataggcatgtgccaccatgcctggctaatttttttgtatttttagcaaagacagcgtttcactgtgttggccatgctggtcttgaactcttgacctcaggtgatccgcccacctcagcctcccaaagtgttgggattacaggcctgagccaccgtgcctggctgaaacttgctttttatacttgacatattgtgaactctttctgtgttattaggtattcatcctgttcaccattttaagagctgcataatactccatagtatggacacataccactctcgagttaactactcttttattgattgccattagattatttctgattttactctcctgtgaataaggatgtggcatctatcacagtagccagatctttgcagacatcacaattaatttcttagtaaacttttctataaaattaatgaatcgaaatatataaaaaggtagggctttaggctggtcrtggtggctgatgcctgtaattccagcactttgggaggccaaggcaggtggattgcctgagctcaggagtttgagaccagcctgggcarcaaggcaaaacgtcatctctaccaaaaaatacaaaaaattagccgagtgtggtggcacatgcatgttgtcccagttgcttgggaggctgaagtgggggggatcacttgagmctgggaggcaggttgtgccaagattgtgtcactgcaytctaacttgggtgacagagtgagatcctatctcaaaaaagaaaaaaaggtaacgcttagatgaaattctgctaaatttttctctagatagcaatttacactctcattatagtgtgtgagaatgcctgtttctttacagcttcatccacaatgaacattataataatgaacacccygcccccctccttttgtaacttgaataggcaaatgaaaaagaagcaaactgtgctaggcctttcttggattgctgtaaagaaacaccacctgagactgtttaattgataaagaaaagaggttttagtttggctcatggctctgcaggctatacaggaagtgtggtgctggcatctgcttctagtgagggcctcaggaagctacaatcacggaggagggtgaccgggagccagcatgtcacatggcaagggcaggagcaagaaagagagggtgacagatggggggacgtgtcacatgctattaaacaaccagatcttgcgtgaactcggagggaaaactcgcacttcaccaaggggatggctgtgagccattcacaagggattcgtccctatgattggagcacttcccaccaggccccatctccaacactgggaattatatttcttcctttttttttttctttgaggcggagtctccctcttttgcccagcctggagtgctgtggcgcgatctcggctcatcacaacctccgcctcctgggttcaagtgattctcttgcctcagcctcctgagtagctgggattacaggctcccactaccatgcccagctaatttttgtatttttagtagagatggggtttcacsgtgttggccaggctggcctcaaactcccgacctcaagtcatctgcccatcttggcctctcaaagtttgtgattacaggtgtgagccaccatgcccaggaggaattacatttcaacgtgaggtttggaggggacaaacatccaaacaatatcacaaactcaaaacttctgggagcctttatatggagttgggagcaccggttcgagtctcccacttagtgagggccacacatccaggatctaaggaattctgtcctgtgtttccacagctgcagtcttgggtgtgagaccaggtgtcatatcaggagaccaattttgttatgtcaaaattgcatgctcaggggtcatggttgtgtcttggacaacctgatccagactcataggccctgatgctgcagccttggcagtgtgagggtccttctgaggcatttcatgttccctgacatgggccatagactccctagatgggaagaatccgtgaaggccctttcaacaaatccactggtcctatccactccacctagcctggaggcttaattacttccagaacctttagagggagggagatggcatggctctttcttggaaagtctggaaggrcaccatgggctagaggggacagacacatgcctcatgtggcctcacaggtcagcctaggacctgtgacagtgacagggagayaggtttggcttaacacaaggaagggccttttgaggagcaaactcccctgaggggtcagccctctcatgggagcagctcaggggagaaggctcagccttggctg

SEQ ID NO: 13304 - DNA, 165156 bp, Homo sapiens
gacaattagtactttctttaatttgatatttagtctcagaattttatagctggaagaaacctgatagaatatcctgtgtagcccagcatactttctgtaaaatgagaaatcctcttcccaatttgtgtgtgtgtgtgtgtgtgtgtgtgtgtgtgtgttaatggcagaataaagccaggctatggacaaaggagaagggagtgatgaggatcaggtgtggcatttgcctttccaaaaaagagattgagtgacttactctaaagtaagttccccttcaaatctaaagcaattgcactatgtcaaactataaaattgcaacaatcaaatttataaatatgatagttttcatcttgatttcttcctcctggatttacagataataaatcttcctcctgagatttattaatccttcctggggaggacttaccattaaaatgtatggtcttttgcattttcaggctgctgttgcttttaccctggtggaagataatcactaaaaagtagtctctgtggattatctaatcaatatctcttcratttcagataaaattttatactcacttgggccttaattattgtgctaatatctctaggcttcccaaatccaggagaactgtgtctgtggatctttagaaatacttggactgactagttttatgctggttctacccttagaatccagaaacaggccagaagcatatcctgttaacttgtatctatgttaagaaaacattgaaaatgtaattattcactatctgatttagaaactgatgttacaattagcatctctgtattggtagtggtaacaacaatgacaacaaattgtacccatagaatttccacagccataactaaaaccagatggcaaatactgtttttataactcccacctttaaaaaaaaaaaccaaaggaaccgtttcttgtttaatttcattctttgatagttgtaatagtaattgacaccgaggaaaaaacaatctactctaaatattctacacagtaaggattaaatttcattttctatggttttactatttagtgggcattgtgatacattctaatctacacattgcccctctacccatgccttgtcttttgtcctcagaatatcttattaatcagaactttcataaacatacacaattctttgactgtttcaagagtcaggctatattttcagctcttgtcttgtttctgtgaatatggtggcagaaatcatggatttgagggtcaactggactggtgtcaagcagtcccctaccgtttattagctgaatgagcttaggaaatcatttgtttaacctttaagtctcaattgtctcatctgtaaaatgaagaggatattatccatctcaggggattcattgttagaatcaaattaaataattgaaattaagtgtgtaacactacgcttcgacacaggtagtaaatgtacgataaatattaactaatattcacacattatctttctcttaaatgaaggaataatacatacttcccttcccttgtgtaagattttttgaagtaacttaacattacaaagcatgtytaatgaatattttaaataatggaactttcaaatatatattatgaacattttttaaaccttaacctagggtaaggtttccattcacctttcactggtttcgaagagttgatatcagttttactatcaacagtaattgaggtttatcactccccaagaggagggtcagttttttttttttttttttttttcagggtttagagctattttctggcaataacaatttctaacttctaattaccctttttccggcttgaaaatctaaagttggattgaagaagagaaatgacaacatctcccttttacttatccaagctgtgaatttaaaatacctttcgtttttgtttgtttgkgcctatcaactttgacccatagctcccagaataattttgatattttctgaataaattgacactagactttatacatcactcatgtctttatttagggtaggccactgtcctctaattccatactgattcttctgggtactctggtgagccactcaaaaaacaatttctgccaaacctttgggaaagtatcagtggtttggtggccaaattcctcatcaaatagtgcaaactggtttcctccaagctgtgacttctgcagagacagaaatgtccttgttaagtaacactgtcctcaaattttctatgtgtatcatagcctacttcctcctgaatactacctttctccaaatcaagactcaaaataatatgttttctttttaatttctatcctaaatcccatatagaaggaaggatgcaagacgtggtctccatgggagacagagtataatcaccaactaggtccaaaagaaaagcaaagtcgtgtcctgggttcctttttccaagttccgagttgtgggaagatgggttgtggcagctcygggagcagacacataggatttcctccttcctcagctctcaggagggccgctggatccaaggcagrggtcaggtatttccgagatgaagtgaackgaatagggcggctacccgaaaggcagtcctcagcattattccaggaaacatcagggcagaacctgaaagaggaaaagaagtacacagctgaaagttagggtgtgtttaacgtagtgagtggaacctcaccgcccacgtgtcatcccctccaggaaatgccatttcctcttccaggaaacaaaggtgtggagaacttctgagagcagccacgtttatataactaagagacagtgtctaatagaaaacagaaacaccccatggcctgggaaaggagatggcgggtctacaggatgctggcatcaagaatatctagaggtgtccrctacacctaatggataccaagaacagatgtgaattttttgttttagatgaaattttacgataaaaaaatcccaattttgtagatatatgatggatgttgttttaaaagatctgatcttcaggttaacgggtttcctgttgtaggactatacgattataggacaattgagtagccaagagtcctcaaagatcagttgtccaaaagagaaagaaagagaaaactgagtgtacgatgtaagaatggagaattggctgggcgcagtggcttatgcctgtaatcccagcactttcggaggctgaggtgggcggatcacctgatgtcaggagttcgagaccaccctggccaacatggtgaaacccgtctctactaacaatacaaaaattaactgagcatggtggcaggcacatgcctgtaatcccagctactcaggaggctgaggcaggaagaatcacttgaatccagaaggcagaggttgcagtgagccaagattgtgccactgcactccagcctgggtgacagaacaagactccatctcaaaaaaaaaaaaaaaaaaggagaattaattattcagcagctcttgagatggtggctccagcctgacctgggtttgaatcttggttctggtactttagtaattgtgggatcttgagcgaggtacataacctttctaagccttgttagtctcttctgttaaagagagatgataatgatgatgatacatatcacatcagattatgaatattatatgagtagtgcgtctaaagtcatcacaggctgggcatggtggctcaccccgataatcccagcattttgggaagctgaggtaggagcatcacttgagcccaggagttttaaaccagcctgggcaacatagtgagaccccgtctctacaaaaaaatctttttaaatattagcttggtcatggtgatgtgtgcctgtagtcccagctatttgggaggctgaggtgagaggataacttgagtcctgggggatcaaaactgcagtgagctatgatcacgccgctgcactccatcctgggcaacacagcaagactctgtctcaaaaagaaaaaaaaaagtccttatcatacctggtgtatatatgaaactttttctaaagccactaactactgattaaattaacaggacatatgagcttcctttcagtgcctaattgtcaatgagaaacccagatatggagcgtgaggaatctaccatcttctaggcacagtagctgttatccgtttgccatttcttctttgcactgtaacaggatccgctgaaaaacaattggagaaagagccagatggatggcagtctgaactagggaagcttctgttttgtagtttgcagaaagaatctgcatggggatcactgcttaagctttgcctctttgtttccagacacagacgcactttcctgcctaatttccatagcaaatacccaatgagcgcctactgtatgccaggttctgatgatgtcagagtgagccagcacttccgaggtactggccactctcaaacctcctggctaggatcttccaagagctacagcctctggcctgagggtcagtccaatgctgttagatattgacaaatgcggggctaattttaatggaatayagttttatccttaaaaggtgtgtgtgttttggctttatttgggttcatatagattaggggcatcatcataactcgcttcctagtgcagacctgagtgatttaatcaagtcttgaaacacttcggggcctcagtttttcatctgccttcccaacctctgaggttctttttagttgacatcctacattcccatgatcagaaggctgctaattcaacttttggcttttgttaaaccttttttttttttttttttttttgaggcagagttttgctgtcacccagactgcagtgcagtggtgagatctcagctcactgcaacctcctcctcccaggttcaaacgattctcctgcctcagccttctgagtagctgggattactggcacgtgccacawcacccagctaatttttgtatttttaggagagacacgattttgccatgttggccaggctggtctcaaactcccagcctcaagcgatccacccgcctcagcctcccaaagtgctggcattacaggcatgagccaccgcacctggcctgttttgttttgttttaatcgtttttaatgtctctctcaaaacaagaaaagaaaaaaggacaaaaaattactattttacttctcagattaatctgatcttagtacactacagcaacaaaagtcttaatcaagtacgttttaattatttggtgtcatcattgcaaggaaaccattcagtaagaatattagtaaccagacatataattttctaacctgaatgagaaattagttacatggagtatagaaaaagaaaccaccccgtttatcctccctgtgaccatcattagtattacccgcaaggcataaaaagtcctaaaatgacacgcacggcggcaacattacctttgcagcttcaagcacagtaaagttgaaagcagtcccaccttggcaattgtgtataaaacgacaatgtgcagatacaggaaaagtcccaggtccgaagccacctaggaacgatgaccccaggacagaagtgtgcccaaacaaatgcctggggtaggtcattttaaaaggaacaatgtttacaagccctttctagcgtgaaaaacagagaaaagagacccagctctttccacccaatctgctggagcgccgtttcgttttcagttgggcgagagggagacatgtggcctctcgccccttttcctgactctgagaatgtggccggagccggggcgctcctgctccgcctcgccgccctcccggggctgtcctgggccctccggccgccgcctcccgctccagttcgcagctgggcgacaagtggctggtaaggaggccaggggcgggagcctgggcgcgggaccgggggcgcacggcgggggaccgagcgcgcgtccctggctagaggtgccgggtcccgggaggccgggctggcggggaggctggcgagcgccccctggcgggcaccgccttctaggcgcacccgcagtgcgccgggcccgccagccccgccagccccgccagccccgaccgccagtccccgcgcagtccccgcgcagtccccgcgcagtcccagcgccaccgggcagcagcggcgccgtgctcgctccaggtagggccccgcgccccgcgccgccgccgggagggagcgggctggaggggccgagacccgtggcgrgaagggctacccrggcccctcggagagcctccgggaaggggtgagggctgccgggtgagcaggcggagtaggaaatggaaccaagcgggcgcaagagcgcaccgggaagaatttccccgstgggtttctgggacgcaggtcgcacgggatgcgggatgctggcgaccttagccgggtgggggccgccggcctgggggcgcttcctcctttcttctcccttttccttctcacctgaacgaaagggggcctgcggggagggaagaaggtggaaagtttttgtattcttggtaaaaaaaaaaaaaaaaatgcgtgaggaaacatgttttctggagrtggtatcctgtccacaggggagcataaccccttttctgggaatgtattggagcacggacgggggtgccattgctcaggcttctaaacaagccaagtttctggtcaagggcctgggggagggggaggcaggtctttgaaagataccaaaaaaaaaaaaaaagaaaaatctgcgtgctcattcctgtagcctcaagtgaggttattccccagctttgagggccaggttaaccaagcaaagtttgtgcaataaagtatctttgtggtattggattttcgagagccaccgttatcaatgggagagtgactgttgaatgctacaggcgtgtgcactcycccgtgggcatgaagagaggtccacgggctggctggattgggagactccggtcatttctgcaaggagagcgccacaggactgccttgttccctgggctgtcctgcccctgtgcgggctggaygtggtgctataaaagatgattcaggagtggcacaggctgagggggactaggctggagaaggtggagggaagagggagcactccgtgccctcttcytgtccatgggaaatgaaccatctgtgcctggtgtccaagtccttgacgttccagttgccctttgagagcacacctyaagcctgctgaattcttttaagaaccacctacaagatctgagaagtccgcccatgctttctgtcaactccggcctctttgaccttttcttttgccaaagaaaattctaaaccactgggattcgtgaggctccgtgagagaggcaagaagcctggagggtccactccgttgctcttttcccttggtttgctccctagaagccatggtccccactgggcccttcttgcccgaggctgtgtgatagacaagccctattcctaaggtcctgggtcccccaccccaccccacaccccgaccttgtgaatcatcatcttcatattttccctaacttatctttggtaacccttgtaaaatggcaggcttactgcggatgcttaatctcttttaaaagtgctgtgtctagcgggaagaagagtgacatttactaatatggttgcaaattactkttgaagtttatgcacagctgtttaaaatccctctgagatcagtgccattgtttgatgcaggtgcttaccgcagaaggctcttgttagtcccttcctcctgctgattgaacatacatatatttaaagacgtggcgtagggagagcttctaaaacctgcaaagccaaagctgcacagctcctgcaagttagcgatccactctaagtttttcwgttgttgtttctgtcttcttgcctctcatgaacttctgtttctgatttcaagagtaacctgctgggcaccatcagcctttgtttcagtgacctgcgattttcttctacactttaaaaatgtcaatatccaggcaagactcttgtcacccaccatccgcgttgtcatgttcatttccgctactgtcttgtgctgtggtgcctcgggatggcaactgttacttgaggagctaacttctacctctgttctcctacagacatgtcctcaytgcgtcttcgctcaccatacacggtgcagctcctggaaatttgattwgttttgctgtctcacttctccttcaggcaacaaggggatggygttcgattattcacacctcagctcyttctgtaatctcaaagatccctttcaacaataatactctctgtctcttgttaacgccaggcatcagaagcccccttacatagccrgcttgtcactggtcatttctataaagtattctcattctaacacatgctgtctcttccgtggaaaagactaaattcttctctgcaatgaattagatgttttaaccaaaattccatgtggactgggtccagaattttctttcaagagtatgggcttgtggtacaagtatgtaacttcggggattcagaagtagacctacacagacaaatctccttataamgtgttatttaattatggtatatttgcctttctggaaattaggaattagagttagtacttcctgtttttaatgcatttgattgatgtcttagagttgctgattatgttkttgcccctaaaaatgttgctaatgtgctggtttgttaacaaggttatatttgatttcaggtgatttcctttttatggagttcagtctttaatttttttcaataatttgcctcaaatcatttaaaatgatatattgttatataatgaaaatcccagcaatatagacgtgattccgtgtgtgtgtgtatgtgtgtgtgtaatctgtaatttaaaatagagaaattagtattgtgacggcatacatagcattaaactcatgcttgctgtttctgttgttttaacactttaagcagctcatttctaagcagctatgtgttcagctcagctttttcatacctattccaattgttaaggaagaagtcatgagaaactatagaaaaatgtgatgttgaaccagagagatggattaaaagctgtttccttacaatggtgaaaatatctttcattattttaacatgccaagcatttatacatgtcaaattctgattgctctgtcatctaaacacattcttggggacaaaatgagcatcagagttttaaaattaggaaagctcactcaagcccagaatcatagatttttgctcctggattaaattagcaagtatttggcaggacatctttctgcaggttgctgtaggttgatgttagcttttgaattaagctaatagtattaattataataataataatcagcatcaacaaaaccaatgaaatatggttttgagtctttattatttagaatttatgtgctgtatatcatactcagaattttatttatatgtaagaggcattactgcttcatttaacctccaaaagcctttataaattagatattattattattccagtttttcagatgaggaaactgaggctcaaggrgtagagccccttgtccaggtcttataaccagtcagtggtagagtcaggttagttggaccatccagattagtctaaccatcaagcatttgctttaaaccgcagtcccaggtgacctaccagttaacttttttattgtggttaaaatacacataacttaaaatttaacttcttaactattttctagcgtacagttcagtgacattaagtatattcacattgttttgcaaccattgccatcatccatccacaggattcttctcatctcctaaaactgaaactctgtcctcgtggaacattcgttcctcatccgtctttcctctcagcccctggcagccacccttctacttcctgtctctaagattctgactgctctagggacctcacagaagcagaatacagtatccatccttttgtaactgtcttatttcacttagcatagtgttctcaagctgtatccatgtgacagcattggacaggacttccttcctttttaagtctgaatactattccatttatggatataccacattttgcttatccttgtatctgttgatggttgcttctatcttttgattattgtgaataatgctgccgtgaagaggaacaygcagatatctgtttgaggtcctgctttcaattctttggggtatgtacccagcagtagaattgtggggtcgtagggtaattctatgtttaattttttgaggaamtgccatattgttttccacagtggctggaccgttttacattcccaccagtggtagaaagggtcccaattattccacattctcagcaacgctgtcttttgttttgtgttttttgagatggagtctcgctgtgtcgccaggctggagtgcagtggcatgatctcagctcactgcaacctctacctcccaggttcaagcaattctcctgcctcagcctcctgagtagctgggactataggcacgcgctgccacacccagctaacttttgtatttttagtagagatggggtttcaccatgttggccaagatggtctcratctcttgacctcatgatccacccaccttggcctcccaaagtgctgagattacaggcgtgagccaccgcacctgggcttttttaaaaatcttctttatagtagcctttctaattggtgtaaggtgctgatagttaactttttacccaatcattgaatgcccaatggcagggatctctgggctgatgctactcctgagttcattgtttatttcctatcccagcttgagcatatacacctttttctagtgtagaattaatggaggaaatacaactcacacagcacctgagggactagggaagccatggaaaggacwgtccctaaaacataaacagaatgtcccggtaggtagggttatctccacctccatgaggaaccttatgattcagaaatgagtagttgttgagaataaagtgaacatggcatcagtgttaataaccctgaatgtgtgggacagatgctttttagaagattagttacagatataattatcttttgtatgttatcagagcaggacaagttcccaggacaatggagagaatggaaagggaaactgctattgaattcaccaggcctttgttgcaagcctcagatcacacaccgtgctgcaaaacccacagggagatgtggtcaggcaaataggaaattataatgaattgtgatgaattcatgagatatttgtactattttgtatcagtttataatgtcatgcaactctgttttatatttgctagtttcctttctgtctcttttttcctctagcatgaaactccatgagggctggcattttgtccctacatgtgtccccagccactctaacagggcctgacacataccaagttgtgaacaaatatgtgcagaatgattgtgtwagtgtttcagtaggggacacacttggtattatgtgcacagctagatttggggtgtcgcagagctgtcagtgacggctcaactgagacctgaaggggaagtggcagtgagccagatgggggttctgggaggtaggaacagtgtttgtagaatgtccctgcagcatgtgagtctggaatcccagtgcagtccagtctaagccttgcagatgagtggaaatgagcagagtaagcatcacagcttccatttaaacctctgctccccatcctaatttgccatatgaccttaaccagtgaacttcttggagtgtcattctctccatttgcaaagtgaagaaaattgtgatctctgatagcagtgatgctgcgagaaaggagcatgtgccagtgtgtgggstattgctgrgtggagctggaggagtcagctgtgccagatcacataggacctgtaagcaggtgaaccatatacgttatcctccagatggggactgtttatagagtgaaagagcacgttattaatcactaagcttgggtaacaggtacaaacccagattgtcctgggcagactgtccygtagagttgtcctgcgttaagtcataygaaggagtttgatccttttctaagaacaggaggaaccctttaaatgctttatctaccaatgtatacaagtgccattcaggttctctccagcgtttcagagagttttacctgcccatgaactcacagcactcggcttgcactgcaaactcacctatacgttggcagctgtctcctcactgggcacttaattcatgaacaactaggagggaaagacarcaagacagccaggggtctgctctttggctctttgcatttttttttacggggtcttgctctgtcgcccaggctggagtgcagtggcacgatctcagctcacagcagcctccgcctctgaggctcaagggatcctccrgcctcagcctcctgagtagctgggactacagttgcatgccaccatggcctggctagtttgtgcactttgtagagatggtgttttgtcatgttgcccaggctagtctctaactcctgggctcaagtgatctgcccgccttggcctcccagagtgctgagattaaagacatgagccaccacacctggcctagctcttttcgcctttaactggagtgttagctgatatcaagaacacatcttttgggtttttctttttttaaccttgtaacacctaaaggactgcggctaagtgttaaaagaaaaaaatttctatctggtggtttaaatatctgcagaagcagaatccttgtcatcctgaaattttttccctgtgggcaagaattcctaataagcgtacaatctattggaaaaatcaaaaagtaaacaaactatggcaatatattctaacatgtattgacttgtcactatcggccgtttgctgtgctaagcactatatgtagatgattgcttgggtgctttgagaacatgtaraagggaaccaagtcctgattcggaggttcaggaaaggctttcagaggacaaggtatcgcgggtgggratggaagatgtatgggaattagccaaaaggacaggggttcagaggtgagccaagtctgtcctgaaagtaagcagaaatgttgttgttcttgtcgttttgagagaagttcatctcagctgtgttcagcatttttagggcataagcttcaacattttccrttctgttttcactgatatgttttagctatacaaaagcaggccttctacacagtttttcaaactccaagacacagtctactagtgggcaatgacattaattttgggggtgataacaagcatgaaatagaataaaacagaaaatattaagatgcatttcatgtaggaagggtaattatttcatgaaactgtatcatttggtttgggacacattaaatctgttcgtacctaaaagaagacattcatgcagccaacaaacatggaaaaaaaaccctcaatatcactgatcattagagaaatgcaaatcaaaaccacaatcagttaccatctcctgcaagtcagaatggtgattattaaaaaatcaagaaacaacaggtgctggcaaagttgcagagaaataggaacgcttttacactcttggtggtgggaatgtaaattagtccaaccattgtggaagatggtgtggcaattcctcaaagatctagaaccagaaataccgtttgactcagcactcctgttactgggcatatatccaaaggaatataaaccattctgttataaagatacatgcacacstatgttcattacagcactattcacaatagcaaagacatggcatcaacccaaatgcccaccaatggtagtctggattaagaaaatgtacatacacaccatagaatactatgtagccataaaaaggaatgagatccctgtcctttgcagggacatggatagagctggaagccatcatcctcagcaaactaacacaggakcagaaaactggacaccttatgttctcacttataagtgggagctgaataatgagaacatgtggrcacagggaggggaacaacacacactggggcctgtcgggaggtgggattggagggagggagagcrttaggaaaagtagctaatgcatgtggggcttaatacctaggtgatgggatgatrggtgcagcaaaccaccatggcacatgtttacccatgtaacaaacctgcacgtcctgcacctgtatcccagaacttaaaataaaaataaaaattaaagaaaattacatacctatggcatttagttttctataccattcctttaagtcatagaatcagatgagctyaggggctagaaggaagagggagcgatgggaaggcagtcgttggtcatgccctgggcctrgatcgcgggaatcagtcattcagaaagccccatatgttgggtgggtctcacagcttacagagaagccagctgaggtgtgcaggttaagaaacttgatctagggtcacagattaaattactagcgctgacccctgatctcttggcttctgatgtggtggtattctttccatacctccagggactgtgttcccaaagtttgttagttaggtggctgtttagggaaggaccacacctggttcctgtttgtttgtttcttggtttgtttgttggtttgttwgtttgtttgtttttgaggcagggtcttgttctgttgctcaggttggagtgctgtgactcartctcggctcactgcaacatctgcctcccargctcaagcaattattgtgtcagcctcgagagtagctaggactacaggcatgcaccaccacacctggttaatttttatgtttttagtagagacagggtttcaccatgttggccaggctagacttgaaatcctggcctcaagtgatcctcctgccttggcctcccaaagtgctgggattacaggtgtgagccaccccacctatcaagggaagatattttcttaaggggagtatgtaataacaaccatgtccctggtttgttargaaggttataaactttgaaatatacccatcagtttcataaagagcaagacaggttaggaagaaatagtgttcattatacagactagagagctttcagcttgacattgacaaatataaacttggccactgtccctccactaaagcgtttcccttgctgctggggaaggaccgcctggtgatgttgtgtgagatgatgcactttctttgccccctctgtggtcactgggatcacagctaaatccaactgtctgctttttccagtgtctacacataggctgatgagttctcccggaaaacacgccgctctgcaaattcaggatgccgtagctctgtgacttcccactccatctaggatctctgtcttccccagctcccagacgtttccctggccaatgatcttccttcccacggcagcttctccacagctgctcctgcctccgccgtcccctcgcactcagcagctgtcttgcctcctgcttccctgagaaagtacaagtttcccgattcagaactgcccccacctggggatcacagggctgcacgcctcactttatctgaatccatcctctcatccttcttttctttcacaacgaaagaaacccctcagttccagccaggcacagtggctcacatctgtaatccaagcactttgggaggccaaggtgggtgaatcacttgaggccaggagttttagaccatcctggccaacacggtgaaaccccgtctctactaaaaatacaaaaattagccaggcgtgctggcgcatacctgtaatcccagctactcgggaggctgaggcaggagaatcgcttgaacccaggagacagaggttgcagtgagccgagattgccccattgcactccagcctgggtgacagagcaagagtctgtcttagaaaaaaaaaaaaaaaaagaagcccctyagttcctgtctgaggctcacctcccctggggccctggaatccatttctttcttgttcttgggaatctcaatctcttatcttccctgtcacctgcattttccttctctccctcatttctggccccattctctctgtattaagtgcgcttaaatcccttccttctgtgaaaaaaagaatatatatccttttataccttcctccagctacttccttgtcttgcttctcttcacaatcaaactcctcaaattgttgtctacacttgctgcctttgcttcctcaccccacatgtcttgaacgacagatgcctggccttgcctcttgcacccctcagaaatgatcacccgcactctcctcatggccgattcccgtggagttctacccgcctcttacctgacttcctgcaaccagatgtgccgtgagcacacatgcatcctgggacattgtccctctgtgtctcccatgacccccctgcccatgtttccttccttccttcctctcttctcctttgcaagctcctcttcttttatcaacctggatgactgatgttcctcaattttcccgccctgtgagcatcctcttccctcatcagcctccatacctatctcctcgctgactgtgacccagtcatgactgccccagatccttgccattcttccccagaaagttcctgggcacgtctaatgcctcatgccccaaactggatgcaccaccttcccctttctctttcaacacgttttctcctcctgctcttttctgcaactggcatagacatcacctgctgcacgacctgaaatctgtgtgtctttccttgattctgtctcccctatctccatagcttgccccaaaccaattttattcactcaccccaattcctctgtgttccctccagcctgtcacactcccaccacctctgctctaattacaggcagcaccgtttctcttctgggttggtgtggaacctcctccctagccgtggttaccatgggctgccttctggaacccagtgtgccactccctgctcttaagttctccaaaggctacccagtgcccccgggataaagcccagcctccctgatgtggattcgaaggttctactcctttcctctccagccctcacatcgggttcctccaagtctgagcctctttaagctcctaggaggtcccagcatcccctcatctygtggacgtctgctcaatctctgagctacttcctgtacatcttcagctcccaagatgtctcttgtcctctggaaagctcttcctgatcctccacatcaggacttggctttcttccacattgtacactccctgaggactggatccacactctctcttactctttttgttgcacttctagcagtcagcattgtgtctgacacgtagtaggtgctcagtaaatattagtgggataaataaatgagtcatatattttagaatctgtaatgcccaaggtactgtgtgctaagtgttagaggaaaagaatcccaatctagtgacttaaatgtctgcacaacagaattactattgtcttggaagattttgcctgtggacctctggagttatctagataaattctaccagaaatcagagctgaagggggtgggaaatgtttagaattccgggaggtgacttgctgcaaagactccatctccccttgtctatggtgtgatttttccccttatcatccccttggcatcctgctttgtggaccactgtaatgtcaataattaaaaaaaagattaaactggccgggcgcggtggctcacgcctgttatctcagcactttgggaggccgaggtgggcggatcacgaggtcaggagattgagaccatcctggctaatgcagtgaaaccccgtctctactaaaaatacaaaaaaattagccaggaatggtgrtgtgtgcctgtagtcccaactactcgggaggctgaggcaggagaactgcgtgaacctgggaggtggagcttgcagtgaaccaagatcacgccactgcagtccagcctgggagacagagcaaggctccatctcaaaaaaaaaaaaaaaggttaagctaagagtgatcaggaaataaaagataatattaaaatattcaaaaatattctataagcaaaagaatgaggcaacaggtaaacataaaatgtagacatagcaaaaattcataagtgattttaataaagaaaaaatagtaaaggataaaagataaaattttgtttaaattaaatgaaaagatattttaagtcttcttcaaaacaaaatcataattttttttgttagttttggggggatttttgtttttgtttttgttttgttttgtttttttcttttttggagacaagagtctcgctctgtcacccaggctggaatgcagtggcgtggtcacagctcactgcaacctccgcccttcgcctcacctgagtagctgagactacaggctcacagcaccatgcctggataacttttgtatttttagcagagacatgttttcatcatgttggccaggctggtctccaactcctgacctcaaatgatctcccaaccccctgcgccaccaccaaagtgctgggattacaggcgagagccaccacgcccagcctataatcacttttaaatgtactaaaatagatacgagtaagaaaggtaaaagactaaattcaagaattaggatgatagaggtatgcccaaaacaaaataaatgaaagcattcacaaaaaaaagaatgtttatcttaaaaggaaagagtagtaaactatttaagggactcacttaaaagtagaataaaccaacattatgaaaccaaagaaaaacataatctttcaaagaagattagaaataaatcccagcagcaataaaataaaatgggcactcacatgtatgggtttctaacaacagctaaaccccagctaaaacaatgttaaagccagtgctgaggtttccagcttgtaccccagaaggccttggtgacctcagggatgtcatagagggaaaacactgggacatttccctcctgaggaatgtaagcacagggtcagataagggtagagaagagagctacactcatctttgtctgcagaattcgggtgacgcgtcttactgtgcaagacttggcaccttgtgcattctggccccaaattgcatctccatccgtgtgttctgctatcctttcagaaatgggaagatatggtgggccctttagggccaagcatatccctgtctttgttcatggaggcctcttctcaaacagaatccctatgtcctgttcatgaaacactatttgcccctactatataattggcatttttttaagtgtcctattgtgttagagcttttccaagtcgcctctgatgtgtggactgactttctgcttcctgtgtctctgggagcttgaggcttctatccttctcattagtggagctccctaatgacattttaatgcaattattgtctcttgagtaagcctgagagcatgtaccgagtcttctctttctctttctctctttaactctcagcacagagctcagacggaaccttggattgaggaggttcatgaggcctcctgtagccagggaatatattttatttccctccagttaccaatatgaaggtttccaaacgttcatatcatattttaggccctaatcattaatattgagagccctaagcactccgatttgggtccatatctaaaggtgagttttaggggatctgactgagaagtgttccgggccagctccctagaaacccttgggtgcactgacttcttcctggccagtgtygtctgcttggtcatcagtgtgttcctcccctcctgagttctctccatctttctgttcttctgttttcttgcagtaatcgaggacaggtggtcgctggcacacaaggatattaggaacccatgaggttgtcccttgtaggagaaaagactggagagaggccactgaatctcgttgtgtcattcaccctacctagtcctgctctgccagggtcatgctcaccttccagacccmcccaacagtgaagtcggactgaaaaatcccagaagtgggaattgggagacaaggttgagtgcattagggggatgtctaggattccccctgattcgaatattttgtagctgttttgaggggtccttttcgcatccagaccaggatttcacctggacagctggagtgggaaagaagtggatacatttcaarctcctagggctgtagttaatgtgtcctgtcataaccactgcagaacagtgtaggtcagagaatgcaaccactggtggcatgtataacccttcaccaataaaccgaagtgcagtcccacaaacatgggagtcattcagctacaattagctttgctatggacaggaggaattaaaatttaataccgtagcaacagcaaaacatgattcgttctacagtgttagtggggatggtaacacaaggaaggttatgataaccaagtttctctgaaaaggtcaagtggatttcctcagtgggctatgtttctggaatataaggtaatggtgaataatagaggaaatctccctctaagaatgggaactctttaattcatctgcattagtcattcaataaaaataaattagcatacattttactggggacctatttagaggggtactatgaacagtagccataaataactcttgcataggaagaacgtgaattactctactttgtaaatattagtttgcaaaagtaattgtggttttgcaattacttttgaggaacgtaattcagtgggaagtaacttgcataattccaagttctgaagcagaggcagctgaaatatttgccattgcaatgaaaaggactttcctcccgggattcttccctagttcctggacaaggagatttgttaatatttgtagtacacttgagatctgcgactaaaagtgctttaggagagaaaagcatcacaagaagaaagggctttttgtttctttttaaaataaaataaatgcaatttctttcaccaaaaaaaaggcgaacattgctaagcataaatgagcacttccttttagaaatgaataaagtaaaactcaaccattakcaacttcccatagctagagctcgcagaggaaaatgttaacacatagcatcatgtttgaattttattattttcatagagaagaaaaccagcaagcaaaccccttctcttgagagaacagccttgaagtactcagaacagagagcatatgtatctattgaaataaaataaagtcacttttctccaggaaaatactatagatattttctcatggaaaaaatagactagacctatgggtctaaatatgtaaacataaagagagatcacactatttattcaagtactgtgctatctcaagacacccagccatgctgctaagaaggcgcattataaagaagcatcaaacattctgcagtttcaaaaagtgaaacgtatatttgcttgartgttcatctaaacactacccataggaaaattcaaacgaaactccagggaattttaatccacatgccacattttcttagtcttttgcaagatagagtcagaggattacattttctgaaaaccgctttttaaaaagcttaagccctaatcagttaagtgtgacaaaggcttgaaatgggatttggtagcaagtaattaaggatgaagtacaagtgggtatatattgacagtggacccatgctattgtcctgaaattgtcagcggggagtttattctttatttgacattgtttatttgacccagagcattgctttgaagatatcaattgctatggaacaaactgctcccaaacttagtggcttaaaaaaacagcaccattgtatttgttcttgattctgtgggctagggatttgggtcagccttggcttggcggttttggtcttcagagcatccctagggccctctcataaggttgcagtcagacctgagatgaggtcactcccttatatggcccctggrtggatgcagctaggaggttgagattcccccaccccgtcttcctccatatgtggccccaaagtaggaagttcctgctgctttggtctttgggtgaaaaacaggtcaygggccaggcaagatcaaggaggggcagcagagggcacttctgggcgagcagtacagtggcatcgcagaaggacaggtgggagggraagggataggctgcakcagctgcctttgaaaacgccatcgagcaatagtattgcagccatttayaccataatatttcctacagaggacctcgtttagtttccgagattgagcctctagtctcgctcttcacaccgctgaagatgtgcggtagaggatcttgctgaaacgaaaatgattgctgcactcccctgcaaagctctttggttactccatatcacctgcaaaatagaatcccgaatctttgcggggcccgtgagttcttcccagcctgtgccctgcctgccagactcaggtttcccttgggtccttgagcacctcgtagctccccagaagcctcttgcattttacagctctgcacctgatcccaggcctgagtgcacttcctcacgctcacatcgttactttgctaacccctgagacctcacctcctctgcaaaggcccccacgggctgtgtcaaggtgtccctcctctgcgtgccctggcatgctgtgcacatggacagctcagcagcactaacacacccttcctccctccccaactgcactgtgagctcccaagggcaggctctgcatctctttgtctgtctagcccctagccctcggcttgagcagagagtcccacacatagcaagtgctcagtaaattttggtggaatgtcagctcagtataggtaaatgacagagtggaggagtgtcggagggaaaagaccagaaaaccctgtacaggaagaaggcggtgtgatcccatggagagttggagcctggggaggcaggaagaggaggaacaaagcggtgggcttagactgcaattggaggctgagagcactctaggtagtcaagagacgcgaacaagcatagaaagtaaagcagaaaatctgattcgatgtaagagaaatcgaggcatgtgtcatggtgaggggcttatagggaagaggcagtgacaaggtaggagagatggcccaacatcaggacgggccatggagacctgtccccatggggagagccctgacctggactcagaaggcagggcacccagaatcccacccacgcacctccagacatgcagtagagctcagtcatagtaggcatgcagtagacctccctgtcaccgagaagaggaggagaggcactgggcaaagtgaggttgctgcttccgggactcttggaactgtgagacttacgctctgaaatcctagctgtcacttacttcactttcgactgaatatcttcactcttgagccaaagtgattgcatgcctttaaagtgaaactgtgcgctgggatctagttgacaagggacaggggctattgttttgttgggggaggggaggtggcagctgagagccaaccaaggaagcccaccttgaaagaatccatagccttttttcaacaaaaaaactaaaaagtaatcactacagaaaatattttagtgctaaatcttggaagaaaacatgatgagtgttcttttgactctgagtatataataattatagctaacatagactgagctttttctgtctactagtaactgttctaatcactttgcatccattaacccatttaatcctattatgatcctcatttttcagataagaaaagtgaggttaaatagcttgtttaaagccacagagctaccatacagcagaactggaatttgaactcaagcagtttgatgccatgatctgtgttcttaatactccatgtagcaaagcctgattttgggactataccttatctactgacttatgtttaaaaatactacctgacattggagttaattctgagaagtgggttttgagacttccttctccctttatatctcaattactgtttggggctatttccttgttttgctgtccaatgtattacttatgttagtaatggagagaacactcactctggttgagcataatcatcaagccgggagctctgctaagatccagtcggcttggctgggttcttctccaggcattctctgctgggccctgaagcgtgcgtctctctgctgaagcatgtgaacattcctcctggtgtttagagagatttggaaaaggctgaaaaaccgcatggaactccggaagttgttgtcttttcagggaaaacttgtgagggagacaggagatggccacagtggttttctttggggtccagcactgaccggggcatttatgaggctgccctgcaggagaaccacacagatgagttcatagacaagcctgagtgggcttctccttcgttcttccttacccacgagcgtccacctcaatccctctctctttcctttccggtatctccagatgccaggtccgtggctcaatgtatttccttcctaccagcattattttgaactgacaatgttgtaaattttaaactatattttaagtaaaccttaaaagcttattttagaatcctaatctgctttttcagacttttrttcacctcagatctccaactccctttactttttgcttgaactctcctcccttcttcctgctttcctcaactctttcatgctgtgtttaataacatgctaaacacattaaaaacagcaagttctatcatatcaacatacatgcccacacccacacacatacgtactgacgactgtcacttgcaaagagctgttaagaagaaagtttgtttaattaaaaaccagcgagaatggtggccagattaacattcttgagtcataacttggaggtttgaacttcaactttatggagccgttctgagaatttaaaaaagtaatctattctgtcatactgtgagatctacataaattattttttggcataggcctttgtaactttttaattgacttttgagtcagtgtgtttctgtgtatgtaaatcaattgtaggttcacgtcaaatttctgattgtctcagatatgtattgtttagtaatatttgacagggtcctgaagcacaagattccaaaaagttcaaaaagatacccttattcaaggaaacatttctttttttcttgtttctttttttttttttttttttttttttttgagacagggtctcactctggtkgtccaggctggagtacagcacaatctcagctcaatgtaggctgcmcctcccaggctcaggtgatcctcccacctcagcctcctgagtagctaggattacaggtgcacaccaccacacccagctaactttttgtatttttagtagagacacagtttcgctgtgttgcccaggctagcctcaaacccttggactcaagcaatctgcctgtcttggcctcccaragtgctgggattacaggtatgagcacccagcctcaaggaaraattttttagtcagcaatttgaaaagaataaattttttttttttttttgaaatggagtctccctctgtcgcccaggctggagtgcagtggtgcaatctcggctcactgcaaactccacctcccaggcttatgccgttctcctgcctcagcctcctgagtagctgggtctacaggtgcccaccaccacgcctggctaattttttgtatttttagtgaagatggggtttcactgtgttagccaggatggtcttgatgtcctgacctcgtgatccacccgcctcggcctcccaaagcgctgkgattacagacatgagacaccgcgcctggcctcaaaagaataatttttaaaatttcaagaaacctatactttgttttggcttggtttctaaaatagaaaataaaatggattatttatatttgaccaaatagacacattttcagaggctgaacaattcactgagtatgtaagcattaggcctgaaaatgaatacggagaaaaattagaatagccacgaagtgcagcatatccgtgaaacactatctcaggggcggagacaaagtcgccacactttctacgggttcattttgtcctgatggttccatgatgcgctgcctcccagccagtgtttgcagaaggtttttagattcagtcatggaggggaagaagaagctgtgaaaaccaaaaacagcacagaggggtttctttctccttccagtaggcttcccagcaaatcaaggatgactgcctgtagcacgccgctcctcacctagtctcaaaatastccagaaagttctccctacaccttattctatccagcacctgaaatgctgycagctaggatcttaggggacacagatcctcttaaaaatgcaagcactgctgagattcccttcacccattagggtggcttaggcagtaacaaagagaaaatggatattttcaaggagaaggggaaagctgggttttattcagtcactaaatgttgactgatcaaacacctaacatgtcagggctttttctgggcgtttaaaatacaggggagaagagaaggagaaaggtactgaccctcgtcaagcctatgcctacttttttttggagtmgaaagacaatagctaagtaaataacacacaaataaggtaaagtcaggcacctcaaatacagtgacttgaccactacacattctgtgtacgtaacraaataccacatgtgccccataaatatgcaaaatatgatgtatcaataaaaacaaamacacacaaaactcaaagaacaataaaacaaagacggtgaagaggtaaagagaatttctagaacctggcctgtttttagattattaaatgtttccttttttgatggagagtgaagaaaaatatctgatattgtacttgctgccacaaaatcatggttaacagaaaaagatacaggccaggcacggtggctcacacctgtaatctcagcactttgggaggccgaggcaggcagatcacctgaggtcaggagttcgagaccatcctggccaacttggcgaaatcccatctctactaaaaatataaaaattagctgggtgtggtggtggatgcctgtagtcccagctactcaggaggctgaggcaggagaatctcttgaacccaggaggtggaaattgcagtgagccgaaactgccactgcactccagcctgggtggcagagcgagactatctcaaaagaaaaaaaattacaaaggagtcactagatgatctagaaaaaggcatgtccctccttccctggcccaaacaatgcacagctcttatctgccccagtcctcaagggctgggaccagggctcttttattacccagaagttcctttgccagttcttttcctggcacctagttggtgactaatgaatatttcttcctagtgagcgtagtataaggtatctgactgtggtcatttatgttcctaatgaggatacgtaacttttctttttaaaccttaactttttattgcctattgctgaaatgttagcagataggccaatgagtagaaagaaccccaagaattgcctgattaattcccactcatgcagcccaggcccaagctctcaccttctgccctgcttttaacggcagcacatgtcaccgctgacgggacstgcctctctgcgcgtgaccatgcacttgggactctctaaatgtctcaccggagaatcaatagccctagttcagctctraatgaagtttctcgtcgcccccttctcttacaccctaaggataaagactgtctctgagaattttccccaaatcttcctaacatagagataaaaatagtaaaataagaaattagacccctcaacttcaactttaaaatcttatttctcttcctgcatcacggtgaccacctcctcacaagtgcaagaatagatgacgatattccagcatgytgtgattctcctaaaaacctgctgctcctagggactctgtggagtgagtttcctggaccgaagtcacttctcagatcttcatgttacacccatgatgtttgcttgctaaaccatcagcttaagttatttatcctgtatcttttatctcagttttctggttgcattttatctgtgtcatctttactttagtcaagctaacgctgtggttttgcaaattaaatcagctgtgggtttcagtatgtaactcctctttgtgtttactaagccttttttaaaaaaaacaaaatagtactgtatgtctgtttacatctttagtagtgtgtaagggaagattgttttctttagagttcttttraacaatttcaaggctattcagaaggatccattttaagaaaccaaaacatctttttaaaatgccttgtttaatatatatctttagccataatggaatccccttaaaattttgaagttgatctgtaataaagaggttgtgtgggtcatgagtctggactttatagttcagacaaagagaatctgcttcatgtttcaaagcaaggaagagatttttttaaaagacagctcacatggcccgtgtaggggtggaaaaggcagcgtgaaagagcaaggggataagtaattaaacatctattggaatcatgaaattattaagagaaaatgtctgaagttccagagctaaaagactgaagagcagtgatgaaatgcaacaaaaataaccagaaaaatccatgggacttgttgcgtagatggttggaggagatgaagatgaaggagaactcagctggttccaatatttctagcttggaagactcagtaagtggtaattccattgatcaagacaggacagagaggagaggtacagacactggaaaaagtagaattcatgtttgtttcagttgtgtttgaggggctggtggaacatcacctggaaaggtccaatatggagttgaatacaggggaccgaagaaagtgaatgtatagttcaagaaagatattctttttgaggctactactaggtagagggtcataggagccatcaaaatagatgagattgaccagaaatgttggtttaaaaaaaagggggaggaaagtcaaaatgtattccaaaatagttaggtaaagaagtgaaaccaacagaataagctgaagagtgagctgagagggaaggagagcaggagagaagaagggagtcgacagtgtcctgtgcartgtcaaggaggaagaccaagaaattgaattaaaatacaattgatagtacagagttacatttggtatagagaaaggtctctggaacaaaaggaagaaggtctctggttgaggaggaagaccatttccagccgcagggtctggaaatgaccaagtcatcagcgctcttgcagggagcaagatagatccacagagtgctggctggaggaatccatatggcagagggcagagaagcgaatggaaggggaggaagcaaagatggttcaggaagctggttggygaaggaagggaggtaaggccatarcagcgggagaagccacggcagaagttgttagaggttgcaaaaccggagggtgtttataagcgggagtgggagacaggcagaaatcacaagaatggcaaggggttaaagaaaagaacaattccaagagtgtgtacagggttaggatcatgtatgcatgaggcattcagggaagaactagatggagactgggataagttgaaccagagcgaaggaagttgagccatttatgtcttgcggcttccagtttttccttaaaattaacaagctcatctgccgaggtggagaaggcagagtcatggttttggagacataaggggaacaagtgtgggacagcccgtttaggaaattggaaaataaacaggccaggaataagatcaaaaataaagccaagattgttggcaaattcagcaataaatcaaatgcttacataattcattgttttttattgtagtgaaaataaacaacataaaatttacaattttaaccactttaagtgtaaagtgcagtggcattaattagattcatgactgtttccagaaygttttcatgacccaagcagaagctctgtacccagtaagcagtaactctccatttccctctcctttcagtcccaggccacccccttctactctttgtctctatgaatttgcctcttccaggtagctcatattaagtgttgcttttttttttttttttttttyccaagacagggtcttgctttgttgctcaggctggagtgcagtggtgcaattacagctcactgtagcctctaactcctgggctcaaacattcctcccaccttaccctcttgagtagctaggactacaagcgtatgccactgcacccagctggtttcttaaattttttgtaragatgtgagttttgctatgttgcccaggctggtctctaacccctggcctcaagtgatcctcctatctcagcctcccaaagtgctgggattacaggcatgagccctcatgctaacctatttgttgcttttaaagcattaatcatggrataagaaaaaggaataagttattcttctgctgtataacactctgtaaatgaagaggtcattcctaaaccatatcctggttttgttgttgttgttgtttgttggttttttgaggcagagtctcgctctgttacccaggcttcagtgcagtggcacgatctcagctcactgcaacctctgcctcccggtttcaagcgattctcctgcatcagcttccccagtagttgagattacaggcatccaccaccaccccagctaatttttgtttttttagtagagacgtggttttgccatgttagttaggctagacttgaactcctgatctcaagtgatctgcccacctttgcctcccaaagttctgggattacagatgtgagctaccstgcccacctggcccataccctgtttttttttaaatccaccatgtggtatccatttataaaaccttattattaatacaatgctatgaaattgatataatgctttacccttaaagtgattcaaatcagctgaagctttgaacctctctaaatcctactttgaattaaatattttctttatcatacgcatacacaacaatgaatgtcttttttcccccatccaaatgatagcacagaattgtgaatctgtttctgtttagtgttctcttccagaggattgcattattcactgaatgtctgttgtctgaaatagaagttcccacagtagtttgtrtacgcatcatttaggaagataagtggtttttcctgttatgtatacaaataaccagtctgtgttaatgtctattatgggtgacatgaacagatccttctcgaggaggtttacatgtgtcactatagcattagatcttttttttttttaacttttattttagatacagggagtatattacatgatactgaggtttagggtgcgattgatcccatcacccaggaactgagcatagtacccaatagttagtttttcaaccctagacccccyccctcccacctttacttgtccccrgtatctatcgttgccatctttatgtccatgagtacccaatatttagctcccacttctaagtgagaatatgcattatttgattatctgttcctgcattcaccacttaggatcatagcctctagctgcaatcatgttgctgcaaaggacatgattccattcttttttgtggctgtatagtgttccatggtgtctatgtactacattttccttatgagcatctaggttgactccatgtctttgctgttgttaatggtgttgccacgaacatagatatgcgtgtgtctttttggtagggtgatttattttcttttggatatatacccagtgatggaattgcaggttcaaatggtagttctgttttagattctttgtagacttagtaatttttaatggaaatgaattatcttcccaatgaaagtaaattctaataaaagacttattgaaagaaatgtctgatattgggatcattttcctaacacaatttccattttcattttctgtaaagcccccacaagagttgacagagttcctgaggtggsgatgagtgagccgtgcctctttctacagtggatgtagtggatgtggcttacagatgccttttacatttccagctgtagacagaaaatgccagaggccacagcatttccccaggccctgaaactaagctaacaccctctaaatattgccaaatcaaagtaatagaaaggaaaactgttctcatattgtctcacttccccaaacatatctcccctaattcagttccaaccacactttaattcccagtttggacccccatttttctcctgaaactactgctggagagttctctctcttyggagttgcagttccttctgcaacgttgcatggactttggtaccaactggccttggttgctttgtatatgagtcctgtatcccaaggagactataatcttcctgacggtcgtgggtttcaattcctagaatcacgaaatagcagcactttacagatgagaacattagacccagagaggtaaagtaacttgcctaaggtcacacagctgaattcagcaaacaggtgaattagtctttcttccctacttgaactactacttgaatgagtgctccgagacttgatgtctgcgacactctgtttttttttttactgtttccactgcacttttttgttctagagacctttctccataccaaatataattctgtactatcaattatattttaatgtataaaattatagtcacatttcaggtcctgcctcccagggataaccttgactaaagttttaggtgctcagaaataatttagtgacacatttatagattttaaagtttggtaagaaatttggaagtaactgccaaagttgaagatatgtgcataccgcaactttgtaggtctattgctttgcatgtattctatcgaaactctcaaatatgttcccaaggaggtatctacaaggatgttcacagcagcatgagttataagaaagtggaggagaaggaggaggaaggaagaagaaggaaawaaaggaaaagatgaaacatcaatagaagaaaagatggatagcatatttctttcttcttcttcttcttttgtttgttttktwtwattwtttwtwtttawttwwttawwttttgagacagggtcttgctctgtcacccaggctggagtgcagtggcactatctcggctctctgcaacctccacctccagggctcaggtgatcctcccacctcagcctcctgagtacctggggccacaggaacacactaccatgcccagctaatttttgtatttttagtagaggcaggattttgctatgttgcccaggctggtctcaaagtcctgagctcaagcgatctgcctgcctcgtatgtctattccgatggaatctgcagcagtggttctcaaagtgtggtccaggagatcattaaaaccttttcagggagtttgcaaagtcaaaactgatttcacagtattactgaggtctatttttccttttcactctcattctgtaccttgaagttttccagagactgcatgttctgatagccacaggctaaacgcagaaactgtcttctattaaaccagacattaaagagatcacaaaagtgtcaaacagtgccactttttttcaatgttttttgctttgaaaaacataattatttatcataaaatatgttgtcttcacgtattacatgataggttttcattatttttaattaaaaaaaatattttaatttttctccttcttattttctgatgtggtaaatattgacagatataatccctataaaccaaagctctttgtttttctcacaatttttaagagaataaaataattcttagagtaaaaagtttggttgggtgcagcgactcacacctgtgatcccagcactttgggaggccaaggcaggaggatcacttgaggtcaggartttgagactggcctgagcaacytagtgagaccctgtgtctacaaaaaataaaaaagaaactagctgggtgtggtggtgcatgcctgcagtgtaactagttgggacactgaaggggaggatcacttgaacccaagaggtggaggccgcagtgagctgtgattacaccactgcactccagcctgggcaacagagcaagactctgtctagaaagacaaaaaaaaaaaaaaaagactaacaggtttgagccctgctgttgcagacagtgagaatgaatgaatggagactgcacgcactgagcctgaatcttggaggcacgatcactggagttgcaggagaatataaacagtgatttatattgtgttttataactagtaaaacatgctgtatgcagaatacatgtttttaggaatatacaggtatataaaacatgtataaaaagttatttttatatttgtgtatatctgaaacactttataatacacttgaaaaactataaatagctatataagctcaacaaccacaaaaaaaattagaaaatgaacaaaagacttgagtagacatttcctcaaagaagatatacagatagccaacaagcatatgaaaaaaagttcactatcagtgatcattagagaaatgcaaatcaaaaccacaatgagatacagtctcacaccagtccgaatggctattactgaaaagccaaagaataacagatgctggcaaggttgtggagaaaatggaatgcttatacactgttggtaggagtgtaaaccagttcaaccattgtggaaagcagtatggtgattcctcaaagagctaaaaacagagctaccattcgacccaggaatcccattactgggtacataaccgaaggaatagaaatcgttctatcataaagacacacgcacgtgtgtgttcactgcagcactatttgcaatagcaaagacatggaatcaacctaaatgtccatcagtggtagatagataaagaaaatgtgggctgggcgtggtggctcacacctgtaatcccagcactttgggaggccgaggcaggcggatcacaaggtcaggagatcgagaccatcctggttaacatggtgaaaccccgtctctactaaaaatacaaaatattagccgggtgtggtggcaggcacctgtagtcccagctactcaggaggctgaggcaggagaatggcatgaacccaggaggcggagcttgcagtgagctgagatggtgcactccaggcactccagcctgggtgacagagtgagactccatctcaaaaaaaaaaaaagaaaaaaaaaagaaaatgtggtacatatgcaccatggaatactatgcagacacaaaaatgcatgagaccaggacttttgcagaaacrtggatggagctggaggccattatccttagcaaactaacacagaaacagaaaaccaaatgtggcatgttctcacttataagtgggagctaaattatgagaacacatggacwcaaagaggggaacaacacacactggggcctgtcagagggtggagggtgacagtagagagaagatcagaaaaaaataactattaggtaccaggcttagtacctgggtgatgaaataatctgtacaacaaacccccgtggcacaagtttacctgtataacaaacctgcaggcgtacccctgaacctaaaataaacatttaaaaaaaagagaagatgctcaacattacttaccattagcaaatacaaattataatcccattagagaagtgcaaatcaaaggagatattgccttgaacccattaggatggctagatcaaaaaacaaaaaataacaagtgttggtgaagacgtggagagttggagcctttttgcacttttgctgggaatgtaaaatggtatagctgctatgggaatcagtacggtggttcctcaaaaacttagaatgactgcatgatccagcaattctaccctgagtatatattcaaaggaattgaaagcagggtcttgaagagatatttacacacccacatcgattagcagcaggattctcaatagccaagaggtggagacgacccacatatccatcaacagatgaatggatgaacaaaatatgctacaaacatgcaatggaggctgggcacagtggttcatgccyataatcccagcactttgggaggctgaggcaggctgatcacttgaggccaggagtttgagaccagcctggccaacatggcaaaatcccatctttactaaacatataaaaattagccgggcatggtggcatgtgcctgtaatcccagctactcaggtggcggaggcatgagaatagtttgaayctgggaggtggaggctgcagtgagccaaggtcataccgctgcactccaggctgggcggcagagtgagactccatctcagaaaaaaaagtgcaatgggatattagactattagccttaaaaaggaaataaattccttcacatgctgtcatgtggatgaactttgaggaaattatgttaggtgaaataagccagatacaaaagaacagatattgcccgttctacctatgagaagtatctcaagtagtcaaattcacagaaacgggaagtagaacggagattgcagggcttgtggaaagggagaatggggagttattgtttaatgggtgcagaatttcagacttgcaagatgtaaaagttctggagatgaatgcccaacaatrtgaatatacagaacactgctgaactatacattgaaaatgattaagatggtgaatttcagccgggcgcrgtggctcacgcctgtaatcccagcactttgggaggccgaggtggccagattaccagaggtcaggagtttgagaccagcctggccaacatggggagagcgctgtctctactaaaaatacaaaaattagccgggcatggtggcaaacacctgtaatctcagctactcgggaggctgaggcgggagaatttcttgagcctgggaggtggagattgcagtgagccaagatcatgccattgcactccagcctagcctggcagacagagtgagactctgtctcaaaaaaaaaaaaaaaaaaagatgaattttatgttatgtgctttttaccatgataagaaaagctacataattgcagtttttgtcattacttttaatggcaaaaattgcaattacttttgtaccaacctagtaatcgctatgacaaacctttgtatgatgggggaattttctgattccctgccctcactccagttatcataaaaataagtcgactgtttctgaatttcccaagtgagtatcttgcccagacttcttgctttagtccagtctttgatgttggctcatatgaagcattctgcccttccagaatatcccgtacttcctccctatctacataaattctacccaagggaactctaatgaatcccattgcagcatgcccaactccatactgctttctccatgatacagtcagaagccaacccagggcacttggattcctcttgccttaaggacccaggacacttattttgtgtacaactagatgttcattacttatatggccccatgtactgcttcttaagttttcagagctgttccatcgctcccattagaatgtaagcccttggaaaacagaggtcctaataacacaacatggcttatacgtgcctgcctcagagctttggcatatggctgtcacacaataagactggtgaatgaatggataaatggatcatggatggatcaatgtggtctttcactgtagctgagctggatgcattaagaattaagtataacatcttctttttttattttattattattatactttaagttttagggtacatgtgcaccatgtgcagtttgttacatatgtatacgtgtgccatgttggtgtgctgcacccattaactggtcatttagcattagttatatctcctaaagctatccctcccccctccccccaccccacaacagtccccagagtgtgatgttccccttcctatgtccatgtgttctcattgttcaattcccacctatgagtgagaacatgcagtgtttggttttttgttcttgcsatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgagaaatygccacactgacttccacaatggttgaactagttgacagtcccaccaacagtgtaaaagtgttcctatttctccacatcctctccagcacctgttgtttcctgaccttttaatgattgccattctaactggtgtgagatggtatctcattgtggttttgatttgcatttctctgatggccagtgatgatgagcattttttcatgtgtcttttggctgcataaatgtcttcttttgagaagtgtctgctcatatccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggyaatgcctaggttttcttctagggtttttatggttttaggtctaacgttgaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtagatatgyggccttatttctgagggctctgttctgttccattgatctatatctctgttttggtaccagtaccatgctgttttggttactgtagcctgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcgtccatttgtttgtatcctcttttatttcattgagcagtggtttgtagtcctccttgaagaggtccttcacgtcccttgtaagttggattcccacaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcgtataaacagaaccaaagacaaaaaccacatgattatctcaatagattcagaaaaggcctttgacaaaattcaacaacgcttcatgctaaaaactctcaataaattaggtattgatgggacgtatctcaaaataataagagctatctatgacagacccacagccaatatcatacagaatgggcaaaaactggaagcattccctttgaaaactggcacaagacagggatgccctctctcaccactcctattcaacatagtgttggaagttctggccagggcaattaggcaggagaaggaaataaagggtattcarttaggaaaagaggaagtyaaattgtccctgtttgcagacgacatgactgtatatctagaaaactccatcgtctcagcccaaaatctccttaagctggtaagcaacttcagcaaagtctcaggatacgaaatcaatgtacaaaaatcacaagcattcttatacaccaataccagacagagagccaaatcatgagtgaactcccattcacaattgcttcaaagagagtaaaatacctaagtataacaccttctttgaactaatgtagcttccacatggctaagctttgtgtatattccttgcaccacgctgaaatttcctttcctctgcaacctcatcttgctctaccccaaggggcacttctactgtaaacctggatggtgtgtggagtgaggcagtcctgactcccctaccctaatcccactggcaccccattttactgccctttttgttttaagacgcttactattaattgatacacaaaaacaggaggcaggtaacaaaaataataaacatcagggcctgtacaccatcatgagtaacacctaacatttgcagttagatatctctgagctcagttccccaccatcccacttactagctgtaggtcctcggacaattcacttgaactctttcttttgttgttgtgctagaayacgcgtaacacaaaatttaccatgtgaaccttttttttttctcgttttcctgagatggagttttgctatgtcccccaggctggagtgcagtggcacaatctcagctcactgcaacctccacctcctgggttcaagcgattctccccgcctcagcctcccgaatagctgggattacaggcacacaccaccacacctggctaatttttgtatttttagtagtttcaccatgtttgccaggctggtctcgaactcctcaccttgtgatctgcctgcctcagcctcccaaagtgctgggattgcaggcatgagccaccgtgcctggcctgaaccaatttgaagtgtacrgttcagggacatgagaacattcacagtattatgcaaccatcgccaccacgcatctccagaaccttttcatcatcccaaactgagactctgtccccatcaagcatgaattccccatttccccccttccaagttcccgggagccacaattctaccctcagtgtctgtgaatgtgactcctctagggactcatttcagtggaactgtttaacatttgtcccttggtgtctggcttctttcaccgagcataatgtccccaagtttcctccatgttgtagcaggtgtcaccacgtccttcctttttcagcctcaagaatattccagtttaacctttgaaagcctccattgcctcttctgtaaaatcggatcagtaggccatttttcaaaggttgttgtgaggatttaataaaatcaggtaaagcaacagacagcgcccagygcagtgctttgagccatgataaaaattaatttagcctccttctcttccctttctaaatgataagttacatgaagaccaggtgcaagaaaaatgcctttctcatgtccgtggttcctgaagtcacacatttgtgagtgctcagtaattaatattatttttaactgaattggataatcttcttatttagcaagttagagattaactcccagagtcccagtatygtaaaaataaaaatgttacattcacattttcccgctatttttcccctatagattaaaaaaaaaaaaacagaaaggaaataatagcagactttgtcactcaggaaaagaaagagttgacttaagacaatgtgggtctgggcgcagtggctcacgcctgtaatcccagcactttgggaggccgaggcaggcggatcatgaggtcaggagttcgagagcagcctggccaatatggtgaaacactgtctctactaaaaatataaaaatttagccaggtgcggtggtacgtgcctgttgtcccagttacttgggaggctgaggcaggagaatctcttaaacccaggaggtggaggttgcagtgagcctggatcatgccactgcactccagcctatgcgatagaaagagactcctcaaaaaaaaaaaaaaagagtgtggggtaggatctccaactgcttaggcgagagaggaggttaaacagtcatcacacaaattcagattctaagggcaggtgaatgaatagaaccaataagtgaagacccagtttccagttatctccatttatcaatgtccttggcctaagtcaattagagttaatcactgtggagttaattacagtgtctctccttgccgttaacaatatattctgtggtcatcgcattattagaatgggcaaattggttcttcagttgacagtgtgaccaggtcattaaacagacaaatctccccgatgaaaaaccttgagcgatgttgattttggtggaaacataaagccatccacaaaccatcctttccaggatggatgtcaggtagtgggaattaagctcaaaactgtgactcacaaacagtttaacttccttcaggttgattttccccrttggtaaaattcccatgaatattctacataaccctttgattcttccaacatcgtttttcccaaacatctttcctgagagctcttcaaaagatggtaaaggtaccatagtaagatacatgatgtaatgaacttgacctcgctgaggggaaaatggccatggtagcctgcttggaagaaatatgcaaaccatctgagaaagagacagctctctcagtgtcgtggggttggaggtcatgtctttccttttcacaacaggaagggctggcaccttctgctctttcggtcctgacaactgtctgctcagagcatcagccaaacaaggccytgtcatcccagccaggaaggatgcgcggtgcatgggagtggcaggacatttgtggaaggagtacagccgaccccccagtttcctccagtccttgtccccaggctggggttccttccagcacttgcagttcagccctgctcagcgtgtttctctggaaaacagaaccgtgggccttgtcagcaacctgctgtgtgagttgggttgtgtgtttgatcatcgaggacagtgtttcagcatctggaggtgtgtgtttgctttccttaggtaaccacaaagtagtggttagcgtctctctaattgataagggtgacagaagctgctgctggctttagaatgatgcctgaactcttcttctgaaaatgaatgtggttaatttagtcatgacagacacatttctgacttyttcctccctccttttttccccaacgccacctttccccatggtgttgtgtttttgcttttgtttttgtttttgttttcctctgtctggagactgaaagagaccagactgcgctcagctgaaagctaagggaagcctgtgctgctccgccagggctgagtattttgttttcagctccgcgaactccacctgtgtgactttttcttcctttctttttaaaagtaaacatggcaggatgtgtgctcaccaattactgagcgcacagaaatacaggaactgctgggctaacgaacacgacttcaaaggacagtggtgaggagcccttgcctccctgccaggcttgaaagggctgagctctccagggagggcagggcccaccctcagggctccaccaaaatagtgacttcccagcctgtgactttcttagagccctgaggaaggactcaacgcagggaaaggacgtgatggcagtggggattccctcttgctttgagcccttctgaatgcaagcagaaaaagaaacccttttatattactttttaattgamtataataacagaaacaatgaaaagaatgtgaccttgactttgcaactctatttcccaggcatattcctaacaacacctaagaaagctaggatgtaggtagcttttatcaccttcgttctttttaggtaatgagttagaagcacaaagcaggcaagagacctcgtaacgtcaaatttaatattaagctgatcttctgatggcccaggacatacccctgggtgctagaatctaacacggagacatggatggtgacgggtacctagtgatccagctgttgaactacacacaattctgctgttgtccccgagggagaactgttcactctgaagctgcagatgctgtgttatagggtgttaaagtctctacagtttctatcaatgctgttgcattcatgttttattgcttctgccaaaatacragtatttcaaggatgaagttcatgttctcccaccagctcttgtctaaaatccatgctcaatgagtatttactgtatgcaggttattactgaagagaggacttatgtgttcttcccatgacatcagaatgcaaggatatttctccaagagagcaggcttctatctgcaaatgcattcacctgaggatagtggtgagacagccactgagcctggcaagtcagcaccactccaggttgttgggctgaaaatagactagagagagtaatctctaggccctcattttataggcaaagaagctgaaacccacagagggtaagcagtttccccatgtttactctgtccttcattgagctttgtattggcttcgttgctcttagtgaaaacacaaggactggccacagttagagccggggtccatgtgtgcatcccaggcttctgcctctgacagagttgaggaacgtgttgagaaggtgtggttgctttccttgaccttaaacttaaatagcgcagaattgctttgggctcagcgttttaatcatgtcacataaaaatcagatgctatccacagagaagaaaaaaaatcatttgaaatgtgcatatgaatatttattagagaaagagtaaagagtagatattacttcatatggaaacgaggaggcttggaggtggctttaatatgcagcatcagtaagaatcaatgcaaagagaatgctatctagcaattttaaatgttcactcaaagagaaatgggcttgaattatagcaggaggattcctgtttagttgttaaaaaaaagataaaaagtaatcagtaggtctcaacatggacttactaaattcatgccagattcacctagtttccatttttgtagagtccccagactaatgaattattagaccagtgagagaacatgatttcaatgagatatctaacaaaatggctcataacactcctattagaaacgtgaaaagtacctagtgggcacctagggggcaacaattccttcagatccaggaaaagggggtctttaggggcaggtcatagaattcggtactggattctgccctagtcatcagcatttctagaaataaatgtccttaagatttagaagttaggccagatttatagcagaccacacaaaactcaaagggtcagtagaatgcagaatcaaaatgatcatgtagactgaaaaactaggccaacgccaaattcagatctgactttggcaaaagcctttacgcagagtcaacagcttaactggtccagggccaggtggggaaatcatgagaacattatgatgaacaggacwccggggttttagttagttgacatttctatctgagttggcagtagaatgtaacgtctgcaaaagtcagttcattcatggtctgcatttatggaccttcagtgcatctagaacttttaccttctgcttatcaaatagtatctggaaatactgattattctggatmtgcattgtaatgatattgacactcatgaaaagatgctcaacacccttcctyagtagggaaatacaacacaaatcaataagctctgcttcacacccattaggatggctattaccaaaaaaagggaaggtggtgttggtgaggctgtgaagatgtgggaccttcttgaattgctggtggacatgtgaagtggtacagactctgaggaaaacagtgcagtgattcctcaaaaagttaaacagagttaccacatgatctagcaattccattcctgggtattctcaaaatagttgaaaatgaggactgagrtacttgtacactaaactccgtggcagcattattcaccatggccaaaaactagaaacagcccaaatgttcatcagcagargaacaaacaaacaaaatggggcatattcatacaatggaatatcactcatccttaaaaaggcatgaaactttctgacacctgctacgacacagatgaaccttaaaaacatgatgctaagtgagatgatccagaaacaaaggacaaatacgctaagactccacttatacgaggttcctagagtagtcaaatttataggcatagaaagtagacgagcagttatcaggggctggtgagtgggaggaatggggcgttagtgttgaatggggacagagtttgagtttgggaagataaaatagttctggagatggatggtggtgatggttgcacaacaatgtgaatgtatgaatgtcactgaactatacaattaaaaatggctagcatgatacattttatattgtatatattttaccacaataaaaaggttattaaacatagactgagtatcctggcagcaagaactagtacaaaaagcaaactgacaaactttgtgtgtctgggcaaagatgatcaagaccataggtctagaaactctgacaaagaaagataactaaaggaatttagttatcatttactgtcaagaagaacaggcagaagagggtgctggccacccttaattagttgaagggatttcctgtggcagaggcattacatgaattccacttattcagagtaaccagagggcagaatcaggaccaatggaagaaattatatccaaggaggtaaatttcagtgcaggaaagaactttcagccaattagaactatattttgaaaagaagcaggggcactgctaaatgcacaactgagtgttcacagtatactcaagaaagacattttatgcaatttgtgatgcagagtgctgcgctgatgagttctctaaagcagcggtccctaacctttttggcaccagggaccagttttgtagaagcctatttttccacagactggggtggggaatggtttcaggatgattcaagcacattacattaattgtccactctatttctattattattacattgtaacatataatgaaataattacaactcaccatcatgtagaatgagtgggagccctgagcttgttttcctgcaactagatggtcccatctgggggtaatgggagacagtgacaggtcctcaggcattagattctcataaggagtgtgcaacctagatctctcacttgcgcagttcatgatagggtttctgctcctgtgaaactctaatgctgtggctgatctgacaggaggcggggctcaggcaggaacggtcactcaccgcctgctgtgcaccccagttcctaacaggccacggaccaccactggtccatggcctgggggctggaggacccctgctctaaagggtcaacataggtgaatttaraaaagtcagcatcctccaagttctcagaaacattctccgattcactgatgagtcgtgaaaatatagtgaggcagaatgttagggccaacagaaaggaaagtagggctctagggattacagtcaccaaggtttctacccttgtgcaagagaaccatcrcttaatacttagtcatgtcattttcaattattaaaaataaattcatcacgcctgtaatcccagtactttgggaggctgagatgggcagattgcctgagckcaggaattcaagaccagcmtgggcaacatggtaaaaccccatctctactaaaatacaaaaaattagctgggcgtggtggggcgcacctgtagtcccagctactccggagggtgaggcaggagaattgcttgaacctgggaggtggaggttgcagtgaactgggtgacagagcgagactccatctacaaaataaataaatgaataaataaattcaaagtccttcatttctagagagtatggaaataggtaaaagtcaacagcttaaaatctgaactaggaaaatcagtcttattccaactccgactttccagagtccatgaccagctggcactaggacaactctggcagacttatgtcactttggtgacgtcaatgtgacatcacagccaagcaaggaaaggcccccattatcttagtgccgactagatgttctaaaggcaggaggagccagggagggggcatcttggtttgaaaaagcttttccccatgtccttcaaactgagccatgcctatgatagatttgaaatgcagcttttgtcgtgacatttcccaatggaacagcttctgtaaaacgtttcctctctctctgctaagaggtcattcctgtctggaatgcctccagtacaaaactagccttgcttctttagcttccccgaggtccagcaaggaaagacctgaaattggttatgaacaggttggcccaggctggcatacccgtcttctgacaatgccgcctccaagctcacccacctccaggctccagtcctggcagcaatgggagttggaccactggaactagcacagtgggcctcaccttagagcaggtactcctgtttctgagcccacagagtgaggcacaatgaagggtgtttcagctggaacagaaggcacatccttggggaagccagcaggagccttggtcccgctttccctgctcctggaggcagtaagccccaagagagcaattcccttccctccttcttttccttcctgttttgcaggaggccagatgttcttttcatgccacttagcttttatttccaaaccatccccggtgaggaagcgctaaactgcagaggcctcggaggaggaagtgcagggaaggggggcgctgtggaagaggaaccagaaaaggggaaagttagcttgccctccctagccctgagtttgcaagtatcaaagtcaaaatgtgtggcttcttttcttggagcaactgagatgaaagtgtctttgagagccccagagaagtgtcagatgaataagatcggtcagtcatcatatctctgcagcaaggaccagcgaagagagctcagtgggagccaaaggtctcctgacgaagatctcaccataaccaactcagccagttgccattaaaaatcctcacagaacagcacttagtttacaggagctcaaagacctgtgaatgctttcagaatagatcccgagaaaggaagaggttctgggcagtgcaatgtcctcaggttagcttctgtggcacctgagttcccgttcccgcagggctggaacaagctgtgcagccttgagcaaaggtcttcacctctctgagcccatttccacatctgtaaagtaaggacaagagaccgacttggatatgtcacaagatggtggcattaaaatggagagatggaacttgaaaacactttgaaaaaacatcggattttgttagtcctcctcatttatttccttaagaggtaaactgaggtatagattaacaaaatggcttattggtttcagtccttttagaacaagatgaaattttattttagaaaacaaagcgagaaataaaaaaaagaatcaccaacttccctgcaagcattcaacaaatgcccatagtataaaaccaacaagaggagtcaaaccgcctcttctgcwtccccaccagccacactccgacacccccactgcgccccatctttctgtccctgatgcttgtcaaattgttccatcgtcagccccaccagagctcatgctactctgagcccctggcttgggagagcgagaactgggatggggaagggtattcttccaaaggcaccgtaggtattgttttgtttctgggagggaaggtggtgcctccagcctctccttcctcttgcagctcgcaagcaaacacagatggaggagatgctctggctgyttttaattctgctttctctcccagggttcttacccagaaaacctattggaatttcaaattttcaaacctcaggaaagtgttgtgtcgggaagatgatttggggttgttttgtgctatcagctgtggggctgggacaggacactgaagcccagtaccccatttggatacygctcttcatcctatttttgcctgggagaagaacagggagaactggctggaggaagaggagaaggggagcggaagaagaagagatttttagagcataataataaaatcgtattttactattagaataattttttatcttccagaacatgttttcagttatagccttgtctgcttcttactaaagtcttatgaggtgtgctattcattagtctacaagtctgctgctgtcatagggctcccaagtaacagtgactgaaagaagacagtggacatccctcccatgtcagagcccgggctcaggcagtcaagggcatagccaaggtcatcgccaaggtcactgccaaggtgatttgacaccatcacatccatgttccagccagtggcaagtggctgggcccaccctgggggttatacccctcagcaaagggacattgaaggaatctgtgtctgggaccacccaggctcagtgcaggtgggggattagagccatgggctgcccggaccttcaaatgccctcacaggtgatcatgtttcacacattccattctcctcatcctcctcattccacggacacacacaaacctccccaygcacatctgcttccccagggtcccccttacttcctactgtccccaagggtgacctagaaccaggggtagggcctgactccactgctcagtaggaaggaagagggcttgtgatccactgccatggctgccctagggtggtgctcctagaactccatgtgggaggctgggggcatttcctcatagatcgatggcaaatccacagcagttggtttcgtcagcttaaaatgagtgacagacagactgactttccaaagcatagagcttatttgggaagagcaggggactgtaatcgggatctgtccgctttgatggatctcaggtgcgtctaaagaggcgcggcgaggggagacttcaaaagaccaagasgggaggtggacacgggctgttttgaaacagcgctcagtgcaggaggtggccttggcgcatggctggagacaggcgtgtcaggccggcagcttgtctggaatactttggttttggggaattccttgcctacttccttcgtaacctcccaggtctttttacttggggtttgacataagtgactccattttgatactggtaactttcacattttcatagcaccatttggtactgaaaaaaaaatgtattaatacatatgtggatttaacatcatgggtaacatttctatggaaaaaatgtatattccctsacctaaacaaataacttattagtaaagttataaatttttgctgtttcttaaattgggaatctcccattatgaggattggaggattcttggaaacaggaactatggcttagatacccacaatactttccacatatggaactcctgataagttggtattaggtgaaagagagacttgttaaattaccaaatgttatcaaaactgggsatccgaatggtgccaggtgatacctgggaccaggtgaacagagaggtcttgtagtggaaagaaactagtgtcagagtcagcagaagtgagccaggttacttacaagctcggcagccttggagaaagtgttaatttctgtacacatccatttttcccttctttataatgggaacaattcatcctacttcacaaaattgttaggacttcaaaccgaataaatatatgaaaaacattttccctttttgttacacagaattattttttaaaatttgaattgcamattccaaaaagaactagttaaaatcaactaatatccagtatactgaaagatagcattttactccaaattttttcccactgacagatttttatctttgtaatgagtttatatatatatatatatatmtatatakatakatagatatatgtttctatttaacttttaagtatattctgtaaatatctttgtttcaataagtaataagccactggttataaaatattccattatagttacatgccattatatatttaaacaatatcttatttttgaatcttcaggctgtttctagttttattattattaaactgtgctgcaatgaacagtcttgtaagtatattttcttacactttccttatcactttaaagtcatttaatacacayttccttctataaagcttgtagaggtctcttatccaaattgctatggcgagatctgcttcataattcatattttataaaggtaataaagttacatgctgtatattacaaaattttcccaaaaagctatgtactggggaaggatattaagagtcatgttcagtagaataaatagactgtaaagagcttcatgtcagactttggattttgctacaaaattagtttatatcacagaataattattttctatttttagagctttttggcatttggaatcacagagaagggattaaagacctggatgatttacctatcttttatttctagtaaaatggaacttgttttattggcccttgataactttacttttgtaaattgcctgttgttagcctttgcccattttttcattaggggatttgccctttttaatgatatttaaataattaaatattttgccacatattttgcaattatgtctcccagctttacgtgtattaataacacacaagttttatgtaaaatagtttggaaatgtttacctttktggggcttgtctgtgggatcatatctaagaagtcattcctaattccaagagggcataattattgatctatgttacctagtacttttagtggtttagcagttttatttctggatgaatatcttcaatctgtctgaatttagtattatattagctttaatgtaggttttagctggtagacacagtctcattcattaagcaatctttccctttcccgttgagtttaaataccatcttctttaaacacaaaacttttatatgtaattggatctgtttctggacattctgttttgttccggtaacctgtccatctcttttgctgccagaaccacattattcccattataatatctttattttaatacctattagggctgggagaaggaaggatgaagagacagagggcatttttagggcagtgaaacttctgtgtgatccactgtaatggtggatccatctcattatccatagaatgtacagcktcaggagtgaacccaggccaggcacagtggctcgtgcctgtaatcctagcactttgggaggctgaggcgggtggatcacctgaggtcaggagttcaagactagcytggccaacgtggtgaaaccccgtctccactaaaatacaaaaattagccaggcatgatggtgggtgcctgtaatcccagctactcgggaggctgagacaggagaatcgcttgaactcgggagatggtggttgcagtgagccgagatcrtgccactgcactccagcctgggcagctgagcaagactccatctcaaaaaaatagaagagtgaacctgaggttcacttatggactttgggtgataataacatgcaaatgtagactcatccccagctctggtgggggatgttgataatgggaggagctctgcatctgtaggcacaggggttaagtgggaattctctgtaccttcttattttactgtgaacctaaaactgctctaaaaaataaaacctattttttaaaaaaacaaaatctaaacattacttttgaagtcatagagcttagattcaggggggaatatgaaaaaaatagaaaattagaatagattgcaatttagcaagtattgcagtaaaacaggatccacagaatagtgcttctttaactctgtggtaaagggccagtgaagaaataaattaccaatatctcttagatttagcagcctcttagttattctcatctttgaaaagctatttgtaaactgtaaagtgctcttgcctattagttatttgccactaatctataatggactccttttaaaaatgaaggtattcactccatctaccttctgctctggagaataatgaaattgcagttaaaaaatgctgtcatgttctcttgagagattggtgtcttgtaagaacaggctgaagtacgtttcagacaagattgggtgcagtcggggtgggatgactgtagactgaagcacatgtcaagattgggtgcattcggggtgggatgactgtagactgaagcacatgtcaagattgggtgcagtcggggtgggatgactgtagaccgaagcacatttcaagcaatgtctcttgtcacaaaataatctgaatggctcaggacaaattcaccaagtaaagtagaagcttgacatttgccaactatgtatcccataaccaagtactgtttttaaaccatgtttttcttaaagaagctaagcttttaatctcttcatattatatgcatatgatgaatatagaaaagccccttttaaagtatgaagaatgagcatttcacccggccactggctgattgaatgccagctactgcactggatgctgctacactgctcagaaatcagtacaagtcacaagcattaagtctgatagggtccgacatctggccgattaaacaatccttcggcatatgtaatattaatactctgtgcatgagcaaatccaatcacctattcaaatcagatcctcactgagtgatgcctggaagagtcaaacactggcccggccaaaagaggaccgagggaggcgctgggagaactggctcctaatcccttcctgctgctaattaggtagatagctttgatcactcaccttaattttctgagcctcagttctctcttctgttacatgagagggcagaccacgagatcaataagggcactttcagctttcaaaatgaaaaaaacaaaaaaacaaaaaacagatccactaactgatttatttcctgtcttattataatggattcatccatttacttattccaaagatgcttattatgaacatcttacatggtcaattcctgtgccacgtgtggtccctaaatgagaagggaatatgggaaagagagagagacagagtccctcaatctaccttcttccattctctgggtggggccagaattcactgaacatgaggaagtgatgagaagtggtgaggaatgggttggggagatattctcggcattgccatttatttagaacagggtttctcagcctcmgcactattggttttgggggggtgcttgggggactagcctgtcatcgtaggttgttgagctgtatctctgacctcaccctactagataccagaagcacaccctcccgccatttgtgacaaccaaaaatatctgtctccagacattgccaaatgttgctcagaggagcaacatcaccctctgagaaccactgatttagaaccrccaggcactgtgctggattctgagcaaatagaaacgagaaagctgctggcctggcctggtggagctgactccagggcagctttgcgaacttcaatatgcatccgttccctggcggccttgctaaagctccatcctcaccccagagcttctcacccagcagctctgggtggggctgcaggatttgcatttttaaagaggtctcagggatgctgatgttgctgtttctccaggaccatctctgagaaccatgtgggctccaccctgctgacaggtgagagtacagatgtccttttctcacatcataaaacaacttaatagttttctgaattcagaaattaggcctccagtggatactcagcctacagtaactctgaaacgtcacagtgaggaggaaaaatagagagtcccgtaagctagaacaatgccaatgggtggtcagtttcatatattccttttggctcctttctgaattagcagatgaacggtcagtgaaggggctggcctaggaacctaagtattacctaattttagagtttctgtggattctaaaccccaaacaactgcagccaagtttttacgacacttgcatttgtaagctggcgacgtttctgactgcarctggatgtgagcaattcacattgccctaaacgcatgcatctgcccagatagacccagctctttctttctgcactttctttctcttcccycggtgcccttccctagtccaccctgtccctctatttgcaacaaccccccctgtgactgtgatagcccagtcccccgttgccgggcagagccggcacatgcgggcttccgtagagtattctctataaaactgttagctcactgcggactgagcactgctgcttccgcttgctgtattgatactaccaaatacygtattttctttgaaaagtgtcacacgcccgcgggaggaagtggggtgtggtgtcacagcagcataggaggacaggagtgtttttgctactggtgtacccaagggcgacagctcactttgccatttcttgctctgactctgacrccaagttcatgggaaccagccatgtctctattcatgggatcaaaggttaagaaagtggagcccaggctctcgaaggctccttctctgaccgcgccctaggaaggagaggtttgccccatacctaccccatgatgtgttgagaacatgaccctgtcccatatgcatatccagtgcagtgctttgcaatatagtaggcagatattccaaatgcttcgtgactaacagcaaaaaacaaatgtgtgtgtcacttcatccccttggcaagtggttcagaggtgttctgggccatgtctgatgacccatgaaacaagttcctatggtattttcatgagggagaatttctaaggatgttttagaaaagtgtggtgtgatcatcgtagccatcttttccaccaaacactgtcatacgcattttccatggattaattcattaaatcatcacaacacagacatagacccaatccttcatagaccctgatgaagtgggtccattatataccttgttttgcagatatgataatgtagtcacagaaagattaagtcacttgtccaagactgtacagcttggaaactgatagagctggcctatactccatgacaccaacatttacaaactgcaagctccttcacatgttaactccttcctgggtctctgtgcctttttgaactcggccatgcaaaggttcgagaatggcaaagcctcatgcccaggggcttcagatccccttctcagtctaggtaccctttgaccagagcacctgagtccctggccccaacttgacgcccctgttttgggtggtgtgctcttcctcactgagcacctacatgacaggaagaaatgtcaggaggactgcaagggatccagcatctcagttagagctgctgggtcacaagatggtagagtcagagagaaggttgtcttttcagagtaaattttgacacaagaagcagagtcctacatttccatttactcctacagaaggcagcatctttgtgtctagtaagtgattatcctaaccatggttagaaaatgatgccagggaggctgagttcctcccaactttatctgatgaagttagcttctttctagactttgtccatagaaatcctcattgatcccaatcagccacttmtaaaggcatgaatggcagaagcttggagggaattgcacaggcttatgacatgctgagaaaattacccagataggcacaggcgccctgacatccagaagagaacttagggtattccgagaaactccatctctgtttatatcacccaattcttcattcttcaaaccacagccatggagtagaaagaaagatcattaagccccaggtacaaggagaaacatcctaatagtgcttaagataattaagcaagttgccaggaaagcctgtccctacagtcataacatgtcctttgcaagtagggacaggtgggagcagacagaaacagtctacagcgaaaactctatgcattcatgtcctccctgacctaaccttcaaagacatttgctaacaagaaataacgtattagtttgggtggagacacttagccaccaaagctgggttcaggtgctgttgcttactcactgtgagtcctttgcacagttttgtgggttgtgggagatccaacacataagccctcttggctatgcttgtgcttagaacaaacggagaggcagatcaggagacagggagatggagaagcatgtccaccagttataacaaaggccagatcgatggagatggctaaaacgttcaggcaaataagttggtcgtctgttcacagcgtcccaggcgatgctggactgtgtcagggaccctctcacccctgccaaccgaggaggatgcgcccccaccccaccccagcctatgacatggccaaggatagtgcagaaatggttctgcagatcagcagatcctgcaacatgagaagaggagggtggagatgggtgggaacggtttattcatgtagaacatgttaaccaaaaaatgagtgactgaggcaagtttctctatcagttgaggtttattgagctaaagtttgaggacacacccgggaaaaacaccagccccagaagcacctgtgacctgtgctttccaaagagggttttaggaactcagtgcttaaggagagggggcaagcaggagggaagagggaggagggaggcagtgaggctctaattagcgcttaccaaatccatgtcttacataagataaggtaaatgtgtgagaacagggagcagaggaacaaatccattatgcacctgcctcagagtcaggagaagagtgactgatctcagctggcccttcttctgtacctgggaagatgagcttgaaatcaacattgtcagttgagttcctaaaacagaactcagttttagaagttaagcttaggttgcagtcctagggttgcaatcggcataggcttgttttgtaggggaatgtggatcctgaaggatttaggggccagaaaggaatttcctcgtaagcagtgtgtgacggtggccatctgggagaagctcggggccttttgtcattgtgggagcctggcttacgtagaatgctgtgacacagggttgtgaagtgaccgctgtctcctggggaaaaagaatggcacggtggcaggacttggcttccaggcttacctctccccttggcataactggtttggggggcctgagattttattttcttttacaaacgtatccatcagatcaatcactcttcttcctggggtacagggatgaggagtgaggataggttagagggatgcaagcctctctgtttgaaaacacagggagggaaaatatgagccttctcataatgaccatgattagcaactgctcggtaagtgatgggtgctgttgtcctcataaccaacatcatcatcattacagtttttatatcttttactgactgctgttttctagatatggaaattatatgacatagacctcaaatatctagtcccatgattcccaataagtacccacttgcccaagaagtttcagtacctggctgctgaaaatacaacttttacatccttagttcatgtgtcttaattcttgattcagaaaagctatcaactgtattctccatatctcaaagttaacgtgtccaaaataaaatgtctcatcttctcatgccatctagttcttcccgcagtgctcccatcttgtgaatggggatggcctcctaccatgggttggggccccaaaccttgaggccgccctgctcctccttttccctcccctcatcttcagtggcttggtacatcccatcaagagatatcggaatccctgcacgctgccagggtccttctgctggtgccctccgaccatcaactggaagagtgaagtcgcccccagtagtctctcttcttctgcacttgctccttacagtcctctcaacacagggaccagggtaccccctttctaggtgtaaataagtctgctctgcactcaaagctgaagacagcacgtagacccctcgggcggtgtcctacctgaactccaagttctcaccatggcctgtggacagccccatgggcacacccacctcgtctgtcttctctaccccttgctcaactccacgcagcccatccsccttcccagaacgtgcttggcagctccgacctcacacccatgtttcggccgggaacgttcacctgccattgtctgtgtgactcagtcctctcctcgtgcaggtctttactcaacgtcatttcacagagacccttcaggaccagcaaagccctccctgccgccccacccagcactccccacctccctcctctgcttagtttgtttcatgggagtcacctggtgtatttcatattatattcttctgctttcttgtctgtctcgtgcatctggacctctgcacaaaggatgggttttgtctctttggctgactgcagtgtcctaagacacttagtgcctagtagctctagtaactgtttgttgaatgaatgaatgagtgaatggatgcatagtcactaaatcagaaatcgtggataytgtaatcatagaacattaggtcataaataccaaggatcctgaggaagaaraagaaagaatatctatgatttggacagccatttttccaattgtggaacattgtttagcatttcaaataatgaaaataaacacatatagaaggcttactatgtkctgggcattgttctgttttatacatattaactcgtttaatctgtgcaatgcacgtaggagtttatggagtttcctcataccttatctcattcagttcccaaaataataccagcagattgtgggtgattacaacattttcaaggattcttccccagggcagctgcttgtgggagagctgaggtctagaaaggaggagttgagagcaggaaaggaaccaagsctgaccccacccccatgccagcattttgatttatggaaccctgggagaagagtttctccaaaatgatacttcatggcctccagcagatccccctcaaagaaaccaacctgggaatgaccctctgtgtggagatcaaggaggaaagaggcaagtgagcctttcttttctcctgctcgtggacttagagtaagagtgtctgggacatccaggtatatactatttccatttttccttttgacatcttcgatgatcaagatacctgctaaggatttgttcagaaatcagaattagttgtaaggcagttgcctgaacaactgaaagygtaatgaccccacagagagcactaaggcaacagaaagtacggcgaggtgggattattaggttggtgcaaaagtaattgtggtttttgccaatacttttaatggcaaagtttttttaaaaagtatttttagtagaggcagggtttagccatgttgatcaggctggtcttgaactcctgacctcaggtgatccgcctgtcttggcctcccaaaattytgggattacaggcatgagccaccatgcccagcytttttttaaatttccattacttttaatggcaaaaactgcaaattactttcacaccaaattaataggatatttgatgagttttaatataattatcgtttttaccacaattgaccttcccctactcttaccctcaaaaaaaaaaaaaaagaacttaaaataaatccatagtcatttcaaaagtgacttcaataattttaaagtcattagttgttgggactctgaaaatgtaggaatcctgttatgcatgacagatttccacggtgggcaacagtcacctagcacrtgcctggtagttcagctgtaatgtgggctaaaagctgatggaaagcctaacccctttttaaacagtatttctatgactggctgaactccgtggtggatggcaaggctgtgtcctacatcagtgagagcmtgcccgctgcagccaggaggcacctcwcagagactggaagcacagagggaggtgggccagctggggcccgaggatccagacttggtgagactcacagaccttggcccactrccctcctccctcctccctcctcacccacttttctcccttcttcacatcagtactggtggcagcaccctgagctgaaggagaaaagttcatattcaacatcagaagttattttatttgtatgtcgctttggtgagagctctgtcctgtaagaggggacctttctcatctaggagaaagtctacccgtacctgtccccatctgagctattaattctatagattctggaaggagaaaaatgaaagtgaaaagtaggtaagaagaaagcatggcagacatgcgcttggaatacgrctgaagacggtagatgtggcaggtggtaggatgctgtggaaagggactgaaatctgaggcctgagtttgaattcaggccctccaagcactttgtaaccataggcaagtcacctaaacttgctgagccccagccataaaatctataaattaataagatggagataactaccatagttgtcctgtccacctgacagctactggaagggtttatggagataacataagtcaaagtgtctatgagagttcattacaataattaatgtgatgactatttttaatattattaggtgagtaactagtaacacccactctttctcataggattttttaaggacctcatgaagcatgagaaagattttgaaagatggtaattgtgcttgggtggagatggcagagctcagaaacagaaggaatggcgtgaacagagccatagagacagatattcagggaaccttcagcaaatcragagaagtccaggcaggctgggactccgctgagagtcgtgctgtgtgaaggaggcaacttgaacccaataaacggaggctttttaataacaggttaagaagctgggactccactgagagtcgtgctgtgtgaagggggcaacttgaactcaatacacggaggcttttaaataacaggttaagaattaggctttaactcaacaaacactgggacagctttcttaagtaacagtgtaacttgaccagggctatgccttagtgggactatctattcatgtaacctattaaaatttgtgtcagaagattaataatgtcatcccaggtgttttattttctatatttcaaggtttaacttcaacactattgttggttttttgggggaaagtgcagagtgttgttaatgttggcaggcaggagggcaacacttggtctgtccacgaagcctccttcatctctagttctgactgagggttgactgttagccttcggtttcctttgtcactgtattgtaggggttattttaaaatattatcttcaatttatactttattattattatcattattttgaaaagggtcttgctttgtcgcccaggctggagtacagtggtgcaatcacagctcactgcagcctcgacatcctgggctcaagtgatccttccactttggcctcccgagtagccggaactataggtgtgtgccaccatgcccagctaattaaaaaaagaaaaaatagagacagggtcttgcattgttcctgaggctggtctcaaactcctaggctcaagtgatcctcccacctcaacctcccaaagtgctgggattacaggcataagctactgcacctggcccatacttactattttaattcacttttgagaycatttttgttggtgaaagctaatatttaatctctttattatactacttagtagaagtcttagcaacaaagcaaaacgctacccaactatgtgattttttttttactagttatcatctttcttctgtgcacattgtgaaaaagtttttttttatgtttcttttaacagcagtcacttttacctaagaaayctttctatctcataaagaaatgcaaamgctattggtgtagcttaatttgccaaaatttttctgaattgatgtttaccaaatttggctgagcagatgtaattggaaaccattgaatgctttgtttctcattcccaratttactattgattaatctgtgttctttcttccacatgtgagaggttttgatacaagtgatgactattgttattttaattctgtgagactctcccccaacactgagccatctcccactaaattatagtaatacaaatgctgtccaaacattttattaaatgaagaagtttgctatttcttatttcatttgctactgargaagagaatgcttgatatttttttcaattgatgagagtatattatacttctattgctttctatttatatggaatttgtccccatcaggttcagttatgtggacatcctcagcatctctataaacgcattctgggagtttgaattgtggagggtgaatcagcctagctaaataggtgagtcagtgtccagagaatcaaaagaccagaattctcagttcagtacataatagcgtgtgacctaaagcactgagcaattatacttgatcatgtacctgcatcgaagctacacacaaaagacaaatgagatcacacttaaagctgaaaatagtgagcctctaagagtaaagatcctttgtaattttaaagtacataggggccgggcgcgatggctcactcytgtaatcccggcactttgggaggccaaggcggatggatcacctgaggtcaggagttcaagaccagcctagccagcatggtgaaacccagtctctactaaaaatacaaaacttagccgggcgtggtggcacgcacctgtaatcccgctactcgggaggttgaggcagaagaatcgcttgaacccaggaggcaaaggttgcagtgagccaagatcgtgccattgcactccagcctgggcaacagggcgagactccgtctcaaaaaaataaataaataaataaataaataaataaataaataaataacataacataacatcacataacataacatagtacatatcatgatggtgttttgcagctggggtagcaaaagcttggaagattggatggacatacctgatatccatcatgataatgactgcatccagatgaggacatcagagggtagtaagtgctctgcaagagatagatggagggttttgtgggagctccgtagcagagtgcagaggaaggtcacataatttaacccagatatgctcctgaaagactatttctactttcctcctgctctttttggtacacaccaatgaagttgagaaggcccattagaaaatatatcagagttgtaataataataactaacatttattgagcatttactttgagccagccccattctaagcaccttgtgtgtatttgcccatttaatcctcatggctctttgggatgagtaatagtattatcagtgatttccaaatgagaaagcaggcttagagagtttaaataactccagcagttcagtgtatgagggcatcgatcttttgtttacaacaagtgctgggctgaatcctttgctcttgactccctctgtaattgtctgtcacttaatttgaccattgtattctcttgcaagtaaaacaaatgcatgagatgaagagatttggtaaaatgttgcttttgaaaatgaactccctaagcaaaaatgcagagtctctagcatatatcagacagggggatcagctctggaggcacatagatgatgaagtcatggccccttctctcggaattgttgaggaagacagacgtgaacccataaatccaactgcacattgtagggaaatacagcagcatgggcgctggcactctgtctcttcccctatcccacaagctgaccacatctccaaaggaatgtgatcacaaagggaaattgtttatcttcactggggatgagggaagtaaggcacccaaatgcactcgttctgaggagtttttgctgaatgtattgcagatgagaccagagagamttgtgtagttggagtcaaacccctcttctgagtgtatgtagcatctcaagaatcaagtaggcgacatcctggtggggctctataagtccccacattagagggctgagagctgggagccacaggatcaaccccactcggactgtagaaatggcaggtgtgacgcaaatcaatatgacaggtgctgtctagcagtgcactcagagaactgcaggagccagggctgagaacttcccatggagatgtgttgatgggagggctctagaggaggggaaggaaggcttccaagaggagctagagactgaacaggaacttgaaagatgaggaagggggcagggaggatggagtgaaacagggaggcgttccagggagaggttgcagctttcctagaaggctgaagctgtgaaacacatggcacattggagaaacagcagcagttttgcaagatcctaagatcattcaggctggagcatggagattggatggagactgagaggtgaccaaggctggacagaggaggcagggtaagaagctgctgtgagtcacaagagaggtggtgcagaatcggtggagcaggagatgaagcaagtgggtcgtgaggcacaaggggaagggtaaagttgaagcagcgggtgagggcygggcgtcgcggcacccagcaccgagctggcaaaatgaaggaaraggcaagtttgaaagggaaggcagggagttctgtatgggacctggtgagtttggggtccccttggagatttccaggagagagtcgaatgcgtgactttattgctcagacaaggggtctatggggggacctagcccctgccttgttcggaacagcctggccagtcagtcttcttgtgcatagattgttgtcataaagtatgagactaccatgtgttacacaatagaccaccaggatggctgaacagtagaaaagaactttattggcaatatcagtttgcacaccgggaagagacagtctttggcgtgtatggaaggtgctctctcttcaaagagggaaagtgcaggctggttttatgcctcccaggttccatattacacaatagagtcagatatattcagaaagctttggggaaaaatctatacatatttatgaggggagttaagtgcaggtgccaggggtaaacatatgtccaacatacatcccatgttcactttggrgcacagttgtagcattaaaattagatcctaaatttggctctttacatcaaaaggcaaatgataggacacaatgacatttagtgtgcagcacctgtaagctgctgaaactggcttggggtctgcatttgcttatcrrgaaagaatgcctggaagcctggttccctgtccaatcagagttgcaggggtctgggttgtaaatcagagttaggaagagtctcaaacttsgcctgattattcttgttattagggagactaacaagggtgtggcttttcctgtagctgtaggaatttaggaggttgtgatgccagccaagccctgaatcctcgacccctgggtaacttttgtttctttaaccttagaatccatcttagctgatgaaggggcaactgtcttggtctctcagatcacacgtgaatggagagtgaagatgagaccgactgaaatttagagtkcacagaggacagatcacacagcttagtcctgaggcaggctattccagcacatatttttgtctacagaaactctcatttctggttaaacacccagggaaatccccttccccctactatctgctccgaacaccaaaaggcaacccatgaaaatcttttatgttaatttctttcttgtgtattcattacacatcttcttggctcttaatatagatggatagatacgcatatttttacatccacacatatacatacataaacacacacatatatacttacatatacacaggtgtgtatatctgttaaatgtggtaatttacatacccagcagcattgtatgaaagtgtatgattcattttgtccttaccaacattaagtaatagcatttcaaaaatatttgataattgcatgggcaaaaacatattattgtttttattatatatttttcttttcttttcttttctttttttaagacagagtcttgctctgttgcctaggctggagtgcaatgacatgatcttgrctctctgcaacctctgcagggagcmaagcgattcccctgcctcagcctccagagtcgctgggattacaggtgccccccaccatgcctggctaattgctgtatttttgtagagagggggtttcaccatgttggccaggatggtctggaactcctgacctcaagtgatctcctcgccttggcttcccaaagtgctgggattacaggcrtgagccaccatgcccagactattttattatatattttaaatattataattctttttacagcttaaattaggacttaaaatgttaatttttcctcaaataaaatgcattattaatttctaatgttattttattctcagctgtgtttgcctaactgcaaatgttcaaaagagcttaaataccacagaaccaaagctattttaattttttaaaagatctgatcatttccctttagtaatttgattactttaagattttaatttaatatgcagctttttcatatatattctttttactttacctctataatctctgtatttataacacatgccttaaaataccaattgcatatatttcttttcttttggtttttgaattatcatacagtaaaattgacttttgscttggtgtagttctgtgaatttaagtctagacttctgtgaccactagaacaatcaagccggagaacagttctgtctttccccaaaatttgctcatgctgctcctccctgctgcaactcctggcaaccactgatgtttttcttcatatagttttgtcttttcaggaatggtacatgcaattacatagtatcttattctgcatgtcttaaattgctcacctggctaaacatttttccacaattagttggaactatgatttttgtatcctgtatagcttgtgcctttgcaatttattttcttgggtcataaacagtgcctttyttacaaatttrtatacccatattatgtaagaatggcgtttacttacttytgttacactaaccatagctatttccctgggtaggtctttactgttaagtttggttattttctttaaatgtataagaccttaccaataggaataacacttgataaataatattgtaatactctggtgatccagtytgatgcagtatccctaaatytgggaaaggttgtaaaaaaaaaaaaaaaaaaaaaaaaaaaaaaaaaagatgctatcttaaagatgcatttttttctggcatgtaraagttggaaacagactaaatatgtagctacagactttagtaacgcaratcgtaragctactgtcaataggatgtcatgcaagaatgacaaggaagcctgagaaaatgtcararaaacttgaaaaaaattttatagtaaaatgttaacttaaaaagccaaatataattccatacccacaggatgatcrtagcatgtaagaaaaaaaaaacacaaaacttgctaatttaaaaagactagggaaaatagatcagaatagtaactgatttcttttattggtggaaatctggagagactttttactaactttgtgtgtcttctttatttttcatcatgatcacctaaaaagtgctctgaactacacagagaaaagcactctgtgtagttcgggtgtaaaacgctgccatctgcctgaaaaactcacacctgagcttgcggttctattgaatgatgtgtgaarattaccacacaaatacctattctgtcttctagatgtcaggtgtatgtcaggtcatgtctgacatacatttctaaaggtctgtgagcagacctttacagaatagtgcaagtgaatctggtgaaacggccgtttaatctgcattgcttattaagtaagaaatcattgtctaggaagaccttcagggggacagagggttttgccccaactctcttccttgctgtaatggaagccctggtcaccctggaggtttccatcttctcttcctggggcagcatttcccagacgcctgctgggctactgttgcctgattagaaacccaccctgggaatagcagggtgacaccagaaaaggtcagggtgctttaactctggctttgtgagttagtgatccctctagactcaaacagaattaaggaaatcttcagaaagtcccracagggcaaaaactcccgtaactgaagatgattcttagtgatttttcctgatttgtggagaaatgaagttttgtctaaaagacccaattggcccaggaaagaagggattctcaaagaaactctctccagagaactcacagctgttagccccgctcctgcctgggaattctaaactcacagggcaaagggcgcctcctaaagacaaatttgtaagtcatctacctgctaattcagcaacgtgacagatacggaacccagcaaatcatgatgtttacccaaccrtctcctttagataaaacttccaaactctgcaggaaattaggacttcattaatatctgtgaaattaatgccygtcaaaagctcctaatttgtctctcttgtggagtcaaagaacactggtatttagcatactggagatcccttttgtcttagmtagatgaggtattacaggcccaagatctccaggtatgttactgattctccttccaggtctttattatttcaaatagttttctttctttatacaaaggcagaaaagacaatcaatgctttgtttcttatctttggcttacttatgaaagcttagaaaaaattataagtataaatcatcaaaaagagagacggagcaaggaagtaacttttttgctgaatatcagatgatagtttcagattaatgggacctcggaaaagtaggtaaaaaagaagaggtatctagttcacataagtggccagaacactcaataatggaacaatagatgaagaattagactagattcctggatttgtagctaacactttgataactatcatctaaacctcttggaaagcataattactgatttttgggcttttatgaagtattttgttcatccttatatgagaaagccctattttatagtagtcaattagtttggagttttctacgtggtttgtgatgttcaaaggcttagagtgtgtgtgtgtgtaactgtgaagaaagcagacctttttgaaaatgtccagagtaaataaggatcagctgccgaatgccttgggccaatcccattacacacataaatagaccatgtaagaattttgcggtgtcatatttaactagtgtgactaaaatagactcgctctatataaactcattttctgattactgtgtgctgtttcctgggcacctacttgaataacagaagacataaaatattggaaaacttttgcctcactctccaaccattgggcctaactccattaggttgaatggaactaactcttgagttacttctcaaaagcaaggttgagtgcagacttccagaaagcctctcccctcagcaagtcagtgtgtggttttgggtgagtccagcagtgtcctctgcagaaggggaagtgaaaacatttgttcacatggatagtggacctatgtgaggttctggctrtccatgataaagcactggttaagtagacatggggcaccaaaaataatatcttttatagcccccaaacagcgtttgtcttttgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcaggtaagcttgaggggattttcaaagcgggggaggaggaggagaatcctgctatgaactgtgtatgaagcaaggtcttccaggacatttgacatcatctggtggaaccaaatcctgccatttaggacrctgatgcccagcaaagccaaggacttcctcatggacacacatttcgtgatggactctaaaccaggacccgatggcccaccggtgctctattgcactgtatcatttttcccacatatacaaagggaaagagaaagctgggttgaggaaattacataaggagttaatgggaaggaactctaatgagctgaagtagaacatagccctatgtggttaagcctggttactttaaataagtctaggtagattaagactgcataatcttccaaccaactctaaagactgcttactgctgctttggcraatcttcagtggatattacaaagcatctataattagccattagaatccaaatttcagaaaacgtacttttgcactcactaaggtcttggctgaatgaaagaatagtgatgtttcatcaagttcaaatacaggcagctcaaggtgagggggaaagtgggacagccacccaacgtcctgtttgtgggttcagaatgttccattccaacagtcttatgtgtagggaatgtctctgtggtcacgtcggccggcttccactctccaagatcttcacctctgcattggaagtttgccacggatttccaaaggaaaagtaggagggagtttagatcccacaactctcctgactgcacaccttttcttgtttccctacgtgcattttgattttagcagacactttgtagggaatgataatgatgatggatgcaggcttgcagtaactatggaagccatcacagttcacttacacaaaagtgtttacggagagaccactgcaagagtgctgggaccagagcrtagagggaaaaaaagtcaaacaagtaagctgaaggaactcaggaagactgccttccctttagagcatctattcttgcagaagaaagtggcaataaacaaaaatacaaacagcaggtaatgaaggaacaaaaagcagtgtaaagaagagagggactgggggcagggatgtgtgttattttatatagggttgtcctgcaaaggcctgtgagygagggacatttgcagatacaagaagaaactgactcagactttgagaacctcctgccagatgctcagagttcagattctggggttcccaaacctactattttgcatcccccaccaaaagcctttttgcttcacagctgactttgtccttccagccactctgaacacatcaaagccagagagactgtctgaatcatcttgatttcctttctgcccagagttctctcctgtttagttaaaagtgtgaatgccacttgctcccaacctaaaacctttcagatgtcacagacatctttgaagtgtaaaacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcctaaatattagcctgtggagttggagggagtttagagatttttgcttttgattttattttgggcttgttctgaaaagaaatcactctgaatattatcattcaatatttacttctacaggatttaaacacatttcagttcttggggtgtaaggctgcattttccacaatgagccaacagaacaaggacaaacaggctacggggctgcggggttgtgagtcgttaaaacggtaacactctacatagatagggccctctgtttaggtgattacaaacgtggcgaatgaaaatgtaaaaagtgccttgctttggggacttttgccccttctcagggtatttttggcccttttctccaggcacagagaatggttaccatcaaaaggaagtatcggaaagggaagcttcaggtctgtggaagtaaaatgttaccgtgatcattaatattgccgttggtttctaaaaagcccaatctccagtccaattttttttttaccaacccacaaaaaatgtcccctttctattccacgtttagtagtctcatggtttatgtctttcctagccaagtttatctaacatttgagtttcaagcttattcaactccttgtatacccccgaaataaatattaatttaacaaatgctaaatgtctgctctgtttagctttgtgtgttggacagaaggggccctcgaaagttagaagggctttatttcctggctttaagcagatttttccccttttgcttaatcgacatctctgaattgctaaatctgccacttaatgtgcttatgtcacaagaaacaaacactcaaatgcaggtttctgcttctgaaatgattaaagaataaataccagagaaaatccaatgtgcgtgaaagacaagaaaaaacttcttaattagtaaactctttgccaatcacagagcggctttagggaggtttcccctagactgaccttcctgtctacagatttgttactatttccagggctcctgcctacctgcctttactcacttgcaggctggcagtcggcttcagccttgctggctccatgggtaaagatcagcaccacctctctgacttgctcatcagcttttgctgagggtgcatggtacatgtaaaatgtatcttcacccaagaattagagaaggaaataatggctcattatgttttaaagatcattgtctcttactgtatttatgtcaaatggaaaaaaatgtaaatatttcttaaaggagcattcattatgcgctgaaattacgccactatgtctttcagatgaacacacagtagttttgtattgactatgtttaagctggggccagtgaggttaatcagtcataggatcaacactacagattaataaaggagaatctcaaaggcataaaagattttttaaaaagtttgttgctcaggtgtttaaacccagagtgaagcaactaactgttgaataggaaaataacattttgaaaccaacccaatagtcccatagacagttgtttttggctgattatagaaatggacccttctgatcttaaagcttggaatttacatttgttttatctgagtttcttcctcaagaaaggatccccacacctctcaaaaaaaatattaaagaactgaaactcaccagatcatggcatccagagactgaagcgccaggcccctggttcatcatgattgcttacttacccctcccragttcctgttttctcatacaaagttacatttcttccctgctatataaatccctagttttagttggtcatggagatggacttcagactgagctctcatctcctcggctgcagcacccaactaaagccttcttccttggcaattctcgtcatctcagtcattggctttctgtgcggtgagcagcagaacttagaatgcctggtgttttggtaacaatttccagtccaaggcattagcagattgttgtctgaattatcaacgctggacttataaggttcaatgcatcaccttgcatctggacccggggactgtctcattctgtcccatattgtctctgattgtttatgtgctacttttgtcttcccaacagaattctatatcccagagaacagagggagcaggtgctactgttgagytgractgaattattttccaggcctggctgaaggaataatgagaccttacgtttctgttcctagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatgggtaacrttgcataaagtgtatgcacataagggataagcatgatggtagccgatgactggctcagaactcccatgtcaatctgagggtgtgattacactggcctcrggtcaccaggctccctaccacttcctactggtgatttgataatggcgatggttattctttatgggctgtagaacacattgacatcttcagatctctttgatgcctacatcaaagagatgtagaaagtctcttagactatgataaattatttaaaactgttaaagcaggcttggaatatctcaaattccccttaagtgggggatgagtttttgtctatcaatccagttgtcagtttcattcactttttcagttttgggaagaatatttgtatataaaacttaatcaagatttatgaaacaacaactctaatgctttttaacttagaaattacttgtttaacccagtagactcagaacacgttaagatatcaaaatcttaattttattaaacttcatcaatacacttttaaagtaagtaaaaagctatcagaatgcgagaggatagaacaaagatccatttaatgtttggtcttctctctctatactttgacaattcctacaatttttttcagctgtaatgaacttagcttactttgactaagaagtgcatcatacacaattcatcttagcacaccaagttgtcaaaaacctggattatggtagtaaatatttagaaatgttaaaaggaggagtaaaataatcaaagcgttaaaaaaattccaatgaaaatttctggggcacaaaataaaagaaaatatatcagtaagaaactgcttttacatgatctgaaatccagaaaatgttttcaaatgtttatatcatctgtgccaaaggagagaatcctgactttctgcttcttactttctataactcagatttttaaacatccacccaaaagattttaaactcagattttaagaaatccacccaaaagattttcaagaactcagattttaagaaatcctcccagaagattttcaagtcacaggtttcaaatgggaatgatacaagcctaaaaactaggtttttgtgtcagttttgtatttttgacctaaaaaaatggatgctttttaagaaagtataaaaatctttgctcgtatcactaaagtaatctttagagacaaatatatgccaagattttttttaaaaggtgctcaggcccatgcttagatatgtccagrtaatttagttgggcagtatctactcagcacttgtgtgttggcttgggaaaagggttcctggggccgggtgtggtggctcatgcctgtaatcccagcactttgggaggccaaggtgagcagttcacctgaggtcaggagttcaagaccagcctggccaacatggcgataccctgtctctactaaaaatacaaaaattagccaggcgtggtggcaggtgcctgtaatcccagctacttgggaggctgaggcaggagaatcacttgaacctgggaagcggaggttgcagtgagcctaattattttattaggtagaagcaggaatgggagaaactgaggaagaccagtttatttggtctacctaattttttttttaaagagtcgtcaattccccaattttaaaaatacgattctattcatgtttccttctcaattaatgaaaggataagtcggagggtgagtatctttttgttaagtagtcttcactgataggcaggttgctgttctatttgtatctcttcaagttgcatatgatttcttgcytaggattttgctgatttcatccttaacagacttttctttgcattctaggattatttagacataagcacatggtggcattcagatgctcatttaaccaactagcacattttttgcacttttaagctttggtgggtttttttgttttcttttttatttttttgccaaggttatttcttaatttacttttattttaagagccaacaggttgttgggacttatattttcccttgcttctattggaatctgcttttccaacactaatttctctaaagaaaatgattctctcaaatttgcctttcatgtttctcaacgccgtattgagagacaccttttgttttcccaaggttgtgactgttttcatggttgtctcccattcactccccaaaatgtgctggaatgtggctttctatgggtgctgtttttccagtagctaattggtttaatttcttccatcactactaagtactgaatactgccaaccttgtggtcacctggtgccaattttcattattccatttggaagcaggccccttaccatagctcttccatctccatttttgcctccatctttactccttattcacaagccagagaacaatggtrcatacatgccatgtcaaaagcacttttcttttcattaatctgttgaaactcatatgaaaatttatagttgttgcagcaatgcaagcttattttatcataaaattctcatggcagtaatgctgtgacataggcattgctattatgtctgtttttcagagatttcccaagacttagtgacttgcacaaggtcacataaccagaaaattatttagccacgattcagattcaatcctgagttccacaggacattacttgctatttcttagttactccggctcacgtggataacccatggacataatgaccaataatgaccttcaagtcattctttcttattctttttggtctgttaatggcatagtgggatggtttaatagattaacaacagygctcagcttgtcttgaacttggatttgtcctttcttctccttatgtcactttatgggagatcctacatcatcccttaaaatgacactttgttccgccctcttctacataataatacagtactgaagtatgtatttatatacatttataaattccttcccagatcagtgtaattagaattttctttagtggaccatccaagactttcctaaaaatacaatctctctttgtgaaagagaaaagccatccccattgaatgccctgattaacctagacatgcatcccaggtagaaaagaagacaggggcctggaggcggcctcaaagaggcaggatttatctttccctccaaaagaagagctttttccccaaggaagccagtcccagtgcctgtgattcttttgtcatgatgaagatctgggtctgccctgtgacagtccttcagatacgcagcattacagggcaagaaaaccaaatagaatctgttttaggattttatttcttccttatgtaagtttttctctccaaataaaattaatgaattgctgggatgttttaagaaaagaaaggcgattgtcacggttgctacagtcgtctgatgacaatgagtttgagtacagtggagagtaacaatgattgtattctgtggtggaaatctcctgccatcgtcagtagccagtgatgtcattgaactcagggcttgtttcacattctgactgatgtttctctccttctcccaaccagttagagctgaaacctcaaggccgaatgctaatgaatgcaagatactttctggaaatgagtggcaagtgacatttcttcttcctgtttgggggtgaggagggcatggccttctcctcaaatgcagcttattttacctttgcaattattgtagaagagaatcaggagaaaagagaggcacaaaattgttttaaaattctcagaggtgctcaggcatgactttaaaagacactatctgggccggaaaaacgtagaaatataaaacatttatagcacttgttttaagtgatgtgaatccatatgcccaaagctcttatactctgtctttagtttagtttgggaattcagtctaaatacaaaagactgttgatgtgtggttatgtgtgtacacattgtctatggttaaatgatgtgctctaagaagctaccatattatcagtagaatacaaaataagtaagaagtcaatcaatatattccataaaattagtaacaaaatgctaacacytgaagttagtcacctcaagtccttttaggaacaagaaaaggtgagaaaacacattgctaaagggttttgattccatgttacaygtggactttggccacagaagtgaaatttcccggtacgatgtgctgagacaggctgtcagggctgtgtatgtgaatcaaatccccctacttagaaaatcctaagtcacagcatggacatgtaaacttactgatggtaaattcacttcattttttcctaaattaattttactaccaagaagaagcaagtttaactttatacatttatggkgctttctgagtttcggcttaccatatataattcctccgtgtctaaattcaaacaaatacatcagagaaaacaatattatgaaataatcatagaaaacttgaacactcactagatatttgatgatattgaggcatggtgaattcatcttttaggtgtgataataatattgcggttatgtttctttaaaaggcacactgatcttttacatatatatgctgaaatattttagtaaaaggcgaaagatttattcgatctgaagaaaaaccagtgaatagctgaaatattttagataaaataatatgataccatagttttgcttcaaaataatccaatggtatggggtgtaggatggacagggtgtattgaaagagagtggccatcagttaataattgctgaaactgaatgattgatatatgaaaattgattatagtatttgctcaacttttaggtatatttgaaattttccataataaaatttttttaaaagaaagaaagaattactgagatgggaaaaatgtactctgaaattttatttatttttcctcttggaaggtgtagatatacagtacacatagtacaacttttgagttggctgaaatagagtgattgcaggatatccgaataaccagatttgcataaaatgtgaaagtgctgacctaaataatagtatcaatgatgtttaattccttgaataagagaaatacattcctcccattagtttaaatcatgacccaatgtaaattgaaaaagggtcytgtctgggcatggtggctcatgcctgtaattccagtactttgggaggccgaggtgggcagatcacttgagctcaggagttccagaccaggctaggcaacatggcaaaacccattctctaccaaaaatacaaaaattagccagagttggtggtgcgtgcctgtagtcccagctacttgtgaggctgaggtgggaggatcgcttaagcccaggttattgaggttgcagtgagcagtgatttcaccagtgcactgcagtgtggatgatacagtgaaagaaagaaaggaaagaaaggaaaggaaaggaaggragggarggaaggaaggaaggaagggagagagagagagggtgagagagaggaaggaaggaaggaaggggaagggaaggagaaagaaagaaagaagaaaagaaagaraaagaaagaaagaaaaggaaggaaggaaggaggagggagggarggaaggaaggaaggarrgagaaaaagggtccttcaaaagaaagaaagaaggaaggaagaaaggaaggraggaargaaagaaagaaaggagaaaaagtgtccttcatcagaatgcaagtatttttggtaaatgattttaagatccctgctttgaaaaacaattccatggatggtccttctattcctgtggaacttaaatattttattagaatgagagagcaaattcaatcgggcaaaaacaatgatattccgtaaacaataatgacataagcctaggaaatgttttaagaataaagctttggccgggcrcggtggctcacgcctgtaatcccagcactttgggaggccgaggcaggtggatccgaggtcaggagaccgagaccatcctggctaacatggtggaaccccgtctytactaaaaatacaaaaaattagccgggtatggcagtgtgtgcctgtagtcccagctactcgggaggctgaggcaggagaatggcatgaacccgggaggcggagcttgcagtgagccaagattgcaccactgcactccagcctgggagacagagtgagacaccatctcaaaaaaaaaaaaagaataaatctttgtaatatttaaaactttttatatctagatccaaattgacactccatctctaaatttttatrtgtcaaaaaaatctaattttaaaaaccaaagttatggaataacctaactagaaaattccttgttgatgacaaggaggagagcattcttttaagaaagctcattattagtataagaaatcgtcttctgaaggattcagaaaagcaaaacgtgttcttctcctcagggaacatatacccagaggtggtacagattagacaattagataaaattataacctaaaccacacaaatactgattaaccaagagatcagtgtgtgttgctttcatttcagtaagttccacagtgtgggcattaaaggttagcaagagttgagttttctaaagaagagggatggccttacaaggaggaaaaagtgaaggcttgagcaagaatatgccttgtgtgagggctgtggggagaacagcctaggtagaccagcaggctcctgctgaaaccagaatgaagagtcagagacagatgttggagggcaagaggagtgcatagtcttgggtcatgctttgaactaatgggaagaatatactttctcttactcaaggaattacacagtattggtctacaaaatttcacttatgttatggagaggtgataaaaatctgttctaagggtgtagctacaggaataaaataaaaggaacartctaaaagaaaatactgttgcagagagatttcatggtagagtagatgaaatatctacagaatgcctgttaagtgtacayagttgaaatgctttataattctttaaaaattaggctgggagcaatggctaatrcctataatcccagcactttgggggccaaggcaggaggatcacttgaatccaggagtttgagaccagcctgggcaatgtagagtgaccccatctctacaagaaaatttaaaaattacctgggtatggtggcacatgcctgtagtcccacctacttgagaggctgaggcaggaggatcacttgagcccatgacttcaaagataaagtgagccaagatagtgccactgcactctagcctgggcaacagaacaagaccctgtctccaaataataataataataattaatccttaaaaatgtaagttgaatgaagggaaaaaatgttgagaatatctcttaaaatagctagactgggaaaatggtagtcacagaagtgggagatatggaaagaggaggaaaatgattgggggataaggaattcaaatttggataacacttgagataataccatgtctcccatgtttctcttccatggaagcctcacctcctctacctcaccaggaagtaaatggctcagctctccataacagactactttgttctttctctttgaaatccccttctgttgggtttttgagcaggaatcattttttctcttcttcctctgttctcctattattactcttgtaacttcagaattccccaatgtcatctcatgcccccctgccaactttctatttcacaccttcctgtgcttctctatccattcagtaaccaaccttcaacccacatatcatcactcagaattctccacctccagggactcacactcagaacttgctttttcagagctcatcttcctcccctggcaattctgcccttattctcagacaataagtactagcctttagtccagtttctcttttaccctatttattagcccactttctggcattaactctacctagcctggytcccatgataagcctttgtcagcactctgctctcattagttcccctttgccatggatagtctgatctccaaaccttgcattctcccctctcattctccccggctttgctagaaaaagtcatacagctaagtgtgttacaaacagatggtattagatgacattcctatggttcagactctatgtttggcttcttagcagacctctctgaccagatttcctgtacttacacattttaaggggtcaaattaaactaagtatccaaaattacatttgccacattcacgagtaacctatttcttttgtaacttactatcgtacttaattatataataactcactccacaaaacctggaagtaatttttatagcctccttttctttcaacttccacatgaatgcatcagtcaatcatttgtgttcgtgttgtctagtcaatattttttccatttcatcatctaattacatcattactacctcctgccatatcccatccattctcctatggtggtcctagaagtaacgatgccaagctcaaatctgaccatatcaagcctctgcccctactgcagtgttccagcatctgcaaattgtctgcaggaaagtgttcaaactgatctgacacctacacatcttctggaagtgactgctgatcgtttctgcttcaccctctgcactctggcaatgcccagctagtgctggacccccacccacaccctgaggaaccttagctctgtagctttgcttgttcccttccacccagagagagcacctttggcttttccccaccataccttctcccacacattagtaggagttacctgtccagaattcagcacagaaacatttctgccaggacgtttcttttccaacttccctctttctctccttcacctacctccacctgccttagctggtatagtttcctcatttccgtggtcccacagcatcctgtgaatacctctgttctgacacatcgattttctttccctctggactcttaactccttgcagaacagccactgtcaaaacaygtctcattaattcctttaactgtggtgccaagtttctggtgaggcatgcaggaagtacacaatgaatgcctgctgaactgttcagctggactcaccttggcacttagaaatctccttcatttctttttgattcccacacaatggctattcctaccattcccatcctccttggtttctggggatgcctcaatctcctctgattctgggaggttgaccttgcctccaatataagtggtagagaccccatcttctttttatttaatttttttatgtattttttttttcttgagacagagtttcgctcatgtcgcccaggctggagtgcaatggtgctatgttggctcgccgcaacctccgcctcccgagttcaagcgattctcctgcctcagcctcctgagtatctgggattacaagcatgttccaccatgcccagctaattttgtattttttttagtagagacggggtttcaccatattggtcaggctggtctcaaactcccgacttcaggtgatctgcctgcctcggcctcccaaagtgctgggattacagttgtaagctaccacgcccagccgagaccctgtcttctgtttgtctctacactttaggatgcagttgcttcctcccgccttctcctcctgctcctctgcctcagagacagctgctccctttcttggttgcacacctctcatcccagcagtcctgctctatcaataaactttacctctgacatcctcaactcttccttctctctgcagtttcttccttattcccaagacatactgcattatgcatcttccccaatcttgaacaycatctcttcttttttttcacctttttacctccttgagtttttttttctttccctaacacattcctttaaaaagtagtttatatttatcagtttctttttcttcccttctacttctattcttagaccctaagactctgggtctccaagattatgagttctcacaagtggttcctgcttcttagccttcaatttccttgayatctctctatcatacaatgctgaaaacttcatttcttttcagcttgcctgatgtgatattgtccaggttttcctcttaatttttcagctgcctcttcttggtctcttttgccatttcttttcctacctcctaaaaaatatgggtacacatatctcggagcctattccacaccatcatatattgcctcttaaggttggctgttctgtgcctgtgccacgtctccctgacttgactgttagccatgcaagggtgaggaataatgtgtttcttcagcacactcagcaaggcagtttactcacagctgctcaggaaacttgtaatttgattgactacaaacaagtgataggttagaccacataaatagattagaatccattagtataaaagaaaaaaaaytgcaaaaaccaatgagctcattcaaaccagtaaatagagaaataaatatagtcaatacaaaaaaaattaaagaattctatgtttttacatttattcttttgtaatgattgaaatagagaataatgaaaatcacagaaaataacagggtattaattcatttctagaaattcctgatattttaaaaaaattatagtactatagtctaatgtagaaattgtgtatataactatatatttatagtttataaaaatataaactatatgtagacatatatgtatataaacatatatgtatagatatatgtayaaaatatgtttaatatacatataaacatatatgatttttacagtaaaaacctgtatagggtccccataataattcactttcattccctgcatttaaaagtgtatttatacttatttttattttattttatttcatctggaccaaaatagaaacaagtcacatgttataaacaaatgacctactatactagtcacaagttgtaaatagatttggacatttagaccagaacttgtggaagaaggtgattaactcagtgatccttaatttaacccctcatttaccaagccaaatctattatttccagcctagttccaggtaaaaagaccaaaattacctactcttaaagtattaggcaaagtattatgtcccatctgtggaactgttagagggttactggaaatgctttttgtctggaagttggggttgccataaaacaartctgcggacactacagaaaagacttcagtcctacaatgtgtcctgggatgtggctggattcctgggggaggtttctacccacacagctcctcctttgtctacctagagtgtttctaatctagccactgttagggattggacaataaggtatcttggaagataatttgccccaaacgcattgtcaggctactgccactgcttagccacaatagaagaaatttagtttgaatattattaactcattgtgaaatatgatgaacctgctttttaaatgaaacctcaatgttttgtatttgtaacaaaatagaagaagtaatccaagagtcttcaagctattacaaaattataactctgggatttaaattcattatccttatttatttattcacatatttatttgtgtatcatttttgttacagcagtggatatttttatttctttactgttccttgtgttattctctctcacctgctgtgtccactgtgctgtttaaccatgactgccttacaatttggtgtttcatgaggacctgggcttcagcaagggcatcctgagcattctcataatttgactatcttagtttttcaaccctttggaaagatgtcattcaggtatagggcactgtaaacagtgactatccaaagcactttcaccaatatttatgagcccagagtaaaatgaatagattgaatctgatggtttgatgctgatgactaggtaatgcacaggattacctagacaccaaaaaaatgcagtgagctattaattttctggcctttttcacattggtaaatatggttggcagctggtgtgtctgatcactgtggacatcaggaaccaggacacaatgtcccaaagttcctttctcctcacacaaaatcctggtcagctccccctagtctactccagcatgtctccaacaacctgctataaagcatcctggcacctctgaaatgctgttcccaagaggctgtcagtaaccatgtgattctctagaattacagacaggaaagcctttgccacttcctgccttttctgactgagtcatcattgatggtgacaaagagaggttgatagatcccttcaaagttctaatctctggttttgaaacttgaagaggatatatcgctcagcccagtcaaagaggagcgaaggattgagccagcaatccaacattgttttcaccctctaacaatatgycctatgatgaatctgtgttgtagaatttgaggaaagatgcttagtgtggtacccaccataatgagtacctggaatgttacagcaggtactcagagctggtcctcctccatcccttgcccatctccctcccctcctgacccagcttagaataggagtcgtccttttgcagaacttcactttcttcccctctctcttcctgtagacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggtacagtaacttggcatctccctccaagcttcgggttatgcattttgttgcgtcttcttaatcctctacgctggcatgctccactgtggggggtgtgctggagtaaatgctacctcagcgttgtcagggaccttgcctgaactgagaaggttcaaatggtgtgatccaataaaagaggtgcatgaggaagccaggtctagtcaggaaaaatgcccatgggattttagtttctgcctcaatgggggggctattgggggtaagtgggaagraacagaagtgaaaggtatctttattacaaacagttttccagttttatagtcaaaacttcccccacctaatggcccaaccctgctggtgctactttttccagcaggcagcactctgccattgtagctaatggtttaaatgcttatgaggctcttgggtatcttaatagccatcaaacagatcagtttaaacctcagtaaccacatagcaaaggctatgacagagtggagacttgaaataactcctgtttctggctctcagcatcctagcctattaagggatactcttccctttaggctactgcagaaactgttaaagcacagctcctgtgtaaccagggtatccacatgccagatcgacttggcgggttttcatcagcctgctttcgtctaatcacttgaacctcctttctctctaatcatggatgtcactcaggaatcggtcctgcatgtgagactttgttggttgcaaatattctcagatgctcagaaagaggaaataaaatgttacagatgtctttgttcgtctgtagtgagctcagcgaggccatgaatttttaaatctagcacagggaaacgtrctacgaagagtctgtgatgcatgcattttcattcatgcattttaatctctatatgtttggaaaatacaaggatgataaatcagccagttctcatttatttaattatcaaactttttaaaamgcagcttcaaatgaaaaacactctgttaatactcttggcaaatgatacaacagggctgctgatcagaaactgctctgtgatcttagggggttatgagatctcatccatctcttaaatgctgttggtgctgatgttgatgccaacattgaaataaatcagcgtgtgctttattacaggggcctgaacaaacagggctaccagtgccgacgtaagtaagagggktttggttgcattaccatcattctttttatttagttattccttaggctatgaaaatcttaagctgtgatttttttcttcttttcagaatgcaatgcagcaattcacaagaagtgtattgataaagttatagcaaagtgcacaggatcagctatcaatagccgagaaaccatggtgagtatttacactcctctttgacgtgcagtgatttttatcagaacgttaaatgttacagcccacgaattcttcagaataatgccagaacttgcatcctcccatttatcagtgaacatccatctccccaaaactctttcctcttcaataatgattcttactgaattacccaaaccagaggatgaattagaaattagccaggcctggtggcataagcctgtaatcccagctactcaggaggttgaggcaggagaatctcttgaattcgggaggcggaggttgcagtgaaccaggaccatgccaccgcactccagtctgggcaacagagtgagactccatctcaaaaagaaaagaaaaaaaaaaaagaaatctgcacttgtacctcctaaatatacacaaattatatacaggaagaattttcattgctctacttttccagaaaaatggcatagaaagtggccagaaagcatagtttagattaattatatgagaataatccttgtggcacccccagctagaagtgacagtaaaagagtaaataaaggcaaatgatgataagatacagcaacatggcatttacaaggttagagataataacagaggcataattttatgttgagaagcaaatatttcttttagagtaaacgttgaggtataatcggaagacaaattacattttacctaatggaggggkgaaactgggctagcacatgggcagtgtatcattatgaattttaaatttttaaaaatttatatgtatttaggaggtacaagtgcagatttcttttttcaatttttttttttttttttttttttttgagatggaatcttactctgtttacccaggctggagtgcagtggtgtcatcttggttcactgcaacttccaccttccaggatcaagagattctcctgyctcagcctcctgagtagctgggattacgggcatatgccaccacgcctggctaattttcgtatttttagtagagatgcggtttcaccatgttggccaggctggtctcaaactcctgacctcaggtgattcacctgtcttggccttccaaagtgctgggattataggcatgagccaccacacctggcctacaagtacagatttcttctatgcctatattacctggtggggaagtctgggcttctagtgaacccaccatccgaagagtgaatattacacccaataggtaattttcaatcctccctccctcccatcctgccatctgtagtctccaatgtctattactccactctgtcactcattatgaaatcttttgacttccttctcccaccgtttcctttttcattccacaaatcctcactgggtatctgattcatggaagataccgcattcttccaatgacagcataacacaaaacagacgtggtcctgcgaagttggagaaacagataataaacagctatgtatggcttcgatttatattaagtgctacaaagatagtgaacaaggtgcaaggtggagagtaagcatgtggcctactgagactctgtggtccgggartctccccarcggagggaacattgaaactgacagctgaagrgtgacagagctggttaggtgaagagcaggaggaaggaagctccttacaggctggaagaccctgctgagggagagtccaaygtgttccaggaactgaaatgggaccagtgtggtgacagctgcaagggctgygcagactggaagcccacactggggaakgcaccaaggcctgggtcatgcggggtttctttggagcctggaaaaatgattgtattttgtgcaacttgtagtagaaagcccactttgggatgctgtagtagaaatagtgcgttgagatgtgaaagtgaaaccagaggagatggaaggaatcctccaagcggggaggttggtggtttataccagtgagacgtcagcagaggtggagcaaaggggcaggttctcaggtgatwttgatgttagaaatgactggatttgccaaaagattagatgaaagaggtggatataaggatgatgccgcaggttctggcttctgcccgaggccgagcagtgtggtagataacagagccacgacggagtgaagaagactggaaggagagatgaatttttccagtttggacatgttgagtcggagaggtggacatccaagttgaagcatcaaatagacaatttcacatgagcttggaattcctctgggacaagggcccaaccctataaatttgacagtgaccatcatataggtagattttaaagttgctgaagagattgcctagtgaggaaatagagaaagttcaggactgactacaaaggaatctaaaatgagatgttaggtagaagataaaggacagagatagacattgagaaactgggctcagagaccrctcctcctacacccagagtctatgaagttacagaaaccagaagaagaagaggtggrttgtgttctgtgcagttgaggtgttgaaattgaggcccacgtgcagatcttcacaggcttaaatcagagaaatgtcaggggcatcttggaggcattagtctgattgacctgcatgaagggtgactgaggtgatgacatgaaaacaacctgtaagttgatattatgaagaaggtgaaccatgaaggagatgatggacagagaacagtggctgggaaatgagaccccaaggatggcaagtgctcccrtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggatrggtgtggagctttggtgatgggcacacaaaggcgcttcccttagactgcatgtgtcccccatggagtttgatggctggaggaaggaaaagagaaagcaacaagtgccttcgaggaaaaaggaagatctatgagataattatcttagagaaagcaaggtgactcgtgaaaagcagtmagactgtggagcagagctgaaagtccatttgaatttgacggagtcagcctgctcaggagtatgattttctccaacaaaggggcaggttcagagaaggcgaagtggctgggtttttccagagtagaatttctcctaacatttagaascagaaggagataaacttgtgctaaccggtgattctgctaagactcaaagaggttaaagtagtttgttcatgtttgatcacctgtacgtggcagagctggtactaaaattaagatcacaatctctcagaccatgtttttgcttgcttagatcaaattttcacctcccagacttcttcctttacttgatgccttcagcttttctagaaaaaaacgcaaatctctgaatcactgttaacctcaatgactaacaaagttcctggtacaaagtcttgagaaactgtcagctacataaataaatgtctgtgatattatcttctcccaggatattttgatttcttgttcactcaaggggacatcatctttgggattcttttgttcctctacccctggagyagtattgtccgatagaaataaatagaatgagggctacatgtgtaattttacatttccaagtagcccacattaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccacctttcaagtgttcgccagccccatgtagctcattggttttcatactggaaagcgtgtacatagcgtcttcatcagccatggtgtcttgagctgtttgcccctscattcaagattcgaagtggtccccttccagcctggaccttgacctattaattgtccatatttaaactgtggaatataagtgagtcccgaaaattatttttttcttggttgaaaatggctgtagtaagtgctgagcaatttttaatcgattctacacaggctttctaaagaaccaacgctgaccagtacccctggcgggaacgttagatctattgctgtgctgatgaataaggcatctttgctatgcaccttcccaaaggaactgttgaattagaaacttctgcagagattataaacctttagaaaataaagcattttatcctgcacaagaatattsacattcttaccaggaatccaactatccaagtgytttgttgttcctgcaataagtttgatttaaactctggaaaactgttttttaaaaaaattccatgtcgatcactarcatccctctcccactcccctctccctaycccgataagccttcacatttattttgagacagaaaagagaatggctgggytctgattctgactgccaagcttatagatatcccagctctagagctgcgtgtcctgggcaagtttcttaccttctctgtgcttcatttcctcgtctgtcaaaggaggatactaatagaagcgacttcaaaaggggtattctgaggattacgtgagataycacctatgtaatagatgatgcgtgtgacatatttgttaaccgcacctggcaggaactgctccctcctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcatctatttaaatgggagcactgtttccttagcactttttaaaataaccctcatgcagtcttcctgagcttttagcctgtctgtgtgaatgcctcagatttcagctgtctgcaaggttcttgctacatgcagaaggcaagcatgccccgtcacgtacagttgctgaggctgcctgccttcttcaggcatgactgtagggcttgacaagtgacaatgatgrtttaaaatgcacacaatgccagygttttcattatgatctctgttagttatgctaaggtatctgcaagaacatccaaagtcggggccccaggaatacacagatttcaccttctgcctttctttcagttccacaaggagagattcaaaattgacatgccacacagatttaaagtctacaattacaagagcccgaccttctgtgaacactgtgggaccctgctgtggggactggcacggcaaggactcaagtgtgatggtgagtccagtgggggatgwgcatggcccgacgtggaccccctaggggatggagcaaggctttctggggaactggagggaggatgtagggggtaccacttccacayccagcccagacaagtcatgatcataagtatggtcttctggggcaataagccactatgttcctttccttgcaccctgcaacacccccacccacacatcccagaaaagagcacaacagttcaggttsaaggtcaaactcctagctccatcaccttctgccgtaccatagccctgggggaaatgaagacagtgtttctcctctcactggtctttctactactagtttcctcagtgggctctgggctgccccttcctaatcccaacaggtctagctgtgtggtaccctaacccttctcctttgcaccagccagtaagattctttctgtcatctcatcaaggagcaagcccagcacattcatttggctgacacatggtcctgcacagaaattctgtaacattagcttgagcatccatccctaaaccattgctgtgaactccaagtgcccagtaagaggctggcccrgttgtgaccgtcattgcctgttttctggtctttcctccaaggccaggatcgcagcagagcctaacctgccattcattattgatggagtttctcagacctaccatcaaaaaaggaaacaaggcaaggctttcttgctgtacaactccaagttgctaaggcgataacgtttagaagctgagatgctgttacactaggattaaggactagggaagaaaaaaaaaaaccctcaagaactgacaaggcactctgctttctggttggggagagacgtgggcagagcccagagaatagagccacaaaaggagaaccacctgttgcatacagacagcttctgatttttttcttcttcttttactttttttctgagacagggtctcactttgttgcccagactggagactggtgtgcagtggctcgatcacagctcactgcagacttgacttcttggactcaagcaatcctcccacctcagcctctcaagtagctgggaccatgggcatgtgctaccatgcctgtttttgttttttttgtttttctttgtttttttttttttttagagrtatggtcttgctatgttgcccaggctggtctcaaactcctgggttcaagcgatcttgtctcctcagcctccaaaagtgctaggattacaggagtgagtcaccatgcctggtgagcacagaccttttcttatgatgaagtattaaatatataagccactttattttttcttggcagccctattttgatcagtgctactgactaatgtatgtcctctcttttgagcaatgaggtacgtgatggaaggcggcacagcatcttccgcattctccccttcttcatcccaatcctgttcacatgtctggtggaacccagagcgacctctcagtggaggcaggaggrgttaggttttcaaatcattacctaaagcagacatcacaggaggccaacattagcctcaagaatccgttcctggccccaaaggacactgacacgcttttctctacacccctgttcaagaagacatggataggcagggtattaagagttcattaggaggtcagagacaaaacgtagtgtcccggcatcctgcatcctgacggtatccacagaaacaggagaaattctcgcctcttggttctcctgtgatggtctcaggtcgggttctctgtcctgggagcccgagaatccacttgcaagaagagctggtcccagcagcgccgcggcacagcttagaacttcccaggggttcctgggcgttatttcatggctcttctgcctgcttcgtttcatttctttcctygaatactctttcctttccgctccattcygttccccgctctctcctaccacctacatttcaagtgctcccctcccctttttcttttgtcccctctcctctccctcccctgccctggtttgttttccattcttgcttctgacactcccgggtccctgcccctccactgtgctcaccccgcctgctccgctcaccccgcatgcccccgcgtcctcctttctcgactctyctcgccctcttctccagctctcttccctccctctctgcctccctttcatcctgcctccttgcaggccgtcgtcttaagtagggcctccttagccttttaccctgccttctctttctccccacaataattcccaagaaaatagtcatccaaagggactctttgccctccaagaaactgagttacggcctgataggttagtaacaaagacttaggaccttctcgtggagatggtggtggcctttcttcgcggccatgcaagtcacagagaagcctagatgtggctacagttttaaggagcaaagtaaaactccatccctctatgttcaatcctagctgacaacctcacttggtgtcasggtgatgcataagaaaatggagctggggctaccgaagttgaaacctracaccttctaaatagggcgaatgtgagttatgcgagttttgccgacaatgtggaatttggagcacwatcatgaaaaaaaaaaatcctttctatrgtaaagattttaggccgggcacggtaacagacctgtaatcccagcactttgggagggcaatgcggaaggatggcttgagcccaggagtttgagaccagcctgggcaacaaagtgagacccccatctctacgaaaaataaaaaaattagtcgggtgtagtggtgtgcacgcctgtggtctcagctacacaagaggctgaggcaagaggatggcttgaacccaggggtttgaggctgcagtgagctatgattgcaccactgcactccagcctgggcaacagagcaagaccctgtctcaagaacaacaacacaacaacaaagattttaaatatgcagaaaagattttgcttcaggtgaatttttctggctatatctatgcctatatactcrgtctagtaatggttaatagttgaccgggcgcggtggctcacacctgtaatctcagcactttaggagaccgaggtgggcagatcacttgaggtcagaagttggagaccagcctggccaacatggcgaaaccctgtctctactaaaaacaaaaattagctgggygtggtgatgggcgcctgtaatcccagctactcaggaggctgaggcaggagaatctcttgaatccgggaggccgaggttgcagtgagccaaaatcgtgccactgcactccagcctgggtgacacagcgagactccatgtcaaaaaaaaaaaaaaaagtaatagttatttacatagaaaattctgctttattttattattgagctatttgaagaagagtggaccagtgaaaactacaggtgagggttgcccaaatttcacctaaatattttaatatctacatctatgcaataaatgatgaagatgaaaaggaagttgtatttgttgagcgcctgctcgatgccagtcattgtgctaagcttctttgcacacacatgtgcaaatcagcagataagattaagactgcatgatgtcatagcacctggtgcctgcttctattacaacactctctactcrcagactctgtcagctggagtttggaaatctttatatctgatttttctgtaytttaatggtgatgtttctttttttttttttttttgagacacagtctcgctctgtctcccaggctggagtacagtggcacratctcagctcactgcaacctccgcctcccaagttgaagtgattcttctgcctcagcctcctgagtagctgggattacagatgtgcaccaccacacctggctaatttttattgttattatttttagtagagatgaggtttcaccatgttggccaggctgctctcaaactcctgacctcaggtgatctgcccgcctcggcctcccaaagtgctgggattacaggtgtgagccaccacgcctggcctttaatggtgatgtttcattagcaaaatttgaatttctaaaactaataattgtctttacacagtcacatgggcacacgctctccagtccaagagggatctcttggtcactggcaatggaagttagattctatgctactgttttcaagattcatgaatcagaatactcaccctgaattgtaggatccccaagctagaatcctgtatagatcatgagtccagtgctggagatccttaatcgggagcccccagagcgttcatgacttgcccaaggtcacacagtgtccacgctgtgcaagctgccaccagcaccccgttctccacccacctgacaggtgctcgagtatttccctctcctctttctttttctttaacatcttatgtgacttataargatgacagaaaactttggttctttttcttcgagttacctttcataacaggttgtagatgtcaatttacgccatcagttcatgcgtgcaagaaatatcactttctttatgactgtgagatccacttagttaacattctcatctagtaatccttggggccctctacccttcccataatcacacgaggttttcaggaggcatgggtacaggggcctggaaactggggaatgtgctcaaacacccggttgctgttggcctcctcatctaagcccacactggtgaagcctgtggctttatgtttccacaccgtgtgtagagtttgtgatttttttttcaaagctgaggtcctcatgcctggtccagtcttgctaggtgtgttctgccgtgacctctcctggcattgctagcctcctcctactccatcccttcccacatatacactccggctccaccgtctgatatccatctgcaggctgaggctgcctcctgggcttcaacctaaaggctgggggaagctcttcatggcccaggtgggaaaggggatgttttggacccagactggagtgggcaggaatattcttctgatgcagggcaggtgagccccaaagtggggcttagcccaggagagttcttggcttcgcccaggaagaattcaagggtcggctgttggtagaagaaaacagcttcattggccaacggtattacagttctgttggtgttacagctccatgactgctcctgcagagcagggctaccccagaggcagagagtagcagctcagggcagtgctgcaatcctatttataccacttttaactacatgcaaattaagttcctggaaaaagggtggtaacgtctgggtgttgccatggcaacactaaactgacatggcacgcaggtgggcatcttctggaaagctgcttctgccctgtccctgttttagctagtcttcaatttggtctggcgtctgaaccccacctccagagttgagtcccacctcctacctcacttcccttccagcacgaggatcactaccagggagagccagggtcaacttcctcccagccrtggcactttaggctttcctccctatcygcaaggctstgtcttacctccagagagagttgtttagcaccagggggttcttccactcttgctcactatctgccttcttccttccagcatgtggcatgaatgtgcatcatagatgccagacaaaggtggccaacctttgtggcataaaccagaagctaatggctgaagcgctggccatgatwgagagcactcaacaggtaggagcatgtgccgtggacacgttcccgccatggcckctcagcaaggatgtccatgcacttctgctgcttcacctgtggcagccctatgggaaatgccsggatgtatttctgagcaccggccttgcccttggctttcatatccatgcccacaccccctatctttgagatatttatttaatgcatttgtattatgcagatctttataaaatcttaaattcttcatggcatgagcattgcagaaacaaataaattcattaaagttattgaagattcattgacagctttatgtgaatatattcgggttatagaatagcctgggggaaaacacttatgtgctagcatcatcctcatggaacaccgagtccagggcaaatttggcctgctgtttactgttttggcattagctgaattcctagatccaaggataaaccctctttaagacttggcattgcctgtatcagctgttttcccatccattaactacctgtccttatttgtgatggaatgatgtagacagcatgagagaatcctgtcagccccagaaaagtgtgaaggaggcaaacgtgttcggctaatgcataaaatacagtagatagactctcccagaatatggggttccaaaagaacgttgaggataaggagatctttgktgaccctatgcatttaaacattttaaatggcctttgtccccatcgttagcaggctgagctgttccatcaatggtgggtgggtgggtggtctgactctctgtttgtcatccaggctcgctgcttaagagatactgaacagatcttcagagaaggtccggttgaaattggtctcccatgctccatcaaaaatgaagcaaggcygccatgtttaccgacaccgggaaaaagaggtagctgtcctgatcagcagtctaatcactgtcagtcattaatctcaattaaccctaacctaatgcccttggatttaagttatcagcttacctggtctgataggtgatccacctccagctaccaactaagaggctcccacttcttagaaaagaaactaaaaccttttacctttgtaaaaggcaggaggtgggggttagaaaatgggataggtctggagggaacaaccacaaatgttttcttagagtttcagcatgttacattctgtcagtgtcaaatggtttcacagaaataaatctgtcttaaaatttgatggtgggaaggccacagaagacattcttactctgcacctttgagacttaaatttaagggtaggaaagagaaggactcaaagccactttcatgacattatggcagtttttccagcctactgtttgaaagcagttcatgagtggatatgacccatgtttctgagacctgagtcgtttcagcatacattctaaaatacttagtgtccttggaagagtatgaaagataaacctagggatttaaaaatatagagactattgtaggcagggggaaattcctaaaaatttctcttatgttttctctgacttcmaatcaacttaaaaatgtaaatgaaaggtttgggttacatttaggaggggttgccaggcagtcaaggagactatgtcttagcaatgatcaacataggcagcatcttttttttttcttttttgaagacagagtcttgctctgtggcccaggctacaatgcagtggcacaatctcagctcactgtaacctctgccctgtgggttcaagggattctcctgcctcagcttcccgagtacctgggactacttgcgcacacaaccgcacccagckaattctttgtattttagtagagatggggcttcaccatgtygcccaggctggcctcaaatgcctgagctcaggcaatccgcccacctcggcctcccgaagttgtcagattacatgtgtgagccaccatacccggccaacgtaggcagcatcttgacttgaattctgggatgaatgatgcagttcagatctttaaaaatctgctagatttcatttcctgtctctctcacgctgtaaattgtagaaattgatgccactgtgtttgtgagccatgcaaasaattgaaaatcatttttttcctaaaatttggttaaaatccctagatgtccttgatgtggcattattaacagtgcttgtgtattttgcatatatggtcttttactgattggaatttgtttcttaagttgaactatttcccagtctattgaagaaagagacatagtccacastccaaaatccaaatgccaggctcacagacagggggtgctgccytcacagacagatggaaaggtattaaagctgcctgaactgtaggaaaccctctaaacacccccaattactatgatggagcctcagcatgggaagtagaagagaaagcatgtgctctcagtaactagaatgacctccattactccatgttcatttttaaccaccagcttgcattttcagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtaagctaatgcacgggagaatgctatggcccaactccaggaactgatgagccaagttcctggtcaaagaaattaaactcatagggccactaggattgcatgtgagtgtcagagacagctttcctgagggagcgctgaataaatagggaccccgagggctctaggcccatagtagcctcagctttctggaaacctgtgtctccaaagctactttgcttggagagtgtacatctcacacgcctatgagtttgatgtctttgggcaccaaagaaataggaaggtgcctcagccacttcctgtttcacacggtgtttgtgtttgtttcattttgttttctcttcttttgcttcattctcaagcctggagtgttgttttagtttgcatgtgatttttttctctctctattaaatatcttccagcttgtataagtttccttggggtgtgatagggctcggctctgtgtccccacccaaatctcacgttgaattgtaataatccccaggtgtcatgggagggacccagtggaaggtgattgaatcatggggatgggtttttctgtgctgttcccatgatagtgagtaagtctcatgagatctgatgattttataaagaggagtttccctacacatgccctctcacctgccaccacgtaagacgtccctttgctcttcctttgtcttccaccatgattgcgaggcctccccagctgtgtggaaccgagtccattaaacctctttcctttataaattatccagtctcgggcatgtctttattagcagtgtgataacagactaatacaggctgctataacaaaatctcacatactggctggcttaaacagcagaaattcatgttctcgcaggtctggaggatggaagttcaccatcaaggtgttgtctggsttgtttcttcccaggcccctctccatgctttgcaatggtcgccctctctccatgccttcatatcatcttcctcctgtgcatgtctgcatccaagtgttctccttttttgagatgacgtctcactgtgttgcccaggctggtcttgacctcccgaacccaagtgatcctcctgtctcagctccctagtagctgggattacagttgtgccaccacactctgcttaaattttctcttcttgtgaaaacaccagtcatattggattaggacctgccttaataacctcatctaaccttaattacctctttgaaggtcctgtctccaaatacagtcactttccaaggtcctggggattggaacttcagtatagacacaattcagcccataagaaaactgtagcttgagagtcctggaaaaaaattgtggagaaagtccctcctctaaattcttcctgccatacatgcaggtggggggttgtctccatcactcacagatgacaaggagaggaaggaaagagggagaggaggagcaaaaaaaaaaaaaaggggaggtgagaagaaggaagaagagataatttaagaaattataaccaactaccggtgactgcagaaaattttcaagctggtgatttaaggagggatgatatggaatataggcttttaggtaatttttgatattaagggtatctcatgtattaacggggctcctatttgttttacattcttggatgggactcccaggaaaattttaatcagagatgactgttctatgaatctgtgcagccaaaggcagcattatacaccacaactgctcaccagactttggcaggatgtcttacccagtttatttaatattaaacaaactaaaatgcaactgagcggtcaccacagctgaataatattgagctccatttggggtttggatttaaacactgatgccttgcctttcagcagaatcgactctgtccagcacatggtagctgatattcadgaattctttttgttcagttccacaataatatgaaccacagtargctcatttggtgctaatctgagcataatargcaatgttacagccagtcttcattgtaatttagcagcaattaatgtgcaattataacctgttaccaaaaattgaaagcacattatatagatggaaattgtctttttggcttcttagtttatggctggttttagggtgttttactgaaagaagcaattactaaaagaggacttttaattgttaatgaaatgtttatctttctttgttcccatgtggatttccacatttgaataaggttaataaggaagacattaagttaaacctacaagccttagtcggtatcccaaggtgcagctgggagccccaggtttccccyactccatgtccaaagctgtctacttcttttcatcaggaccctgggtccctatacacggagaggagaggagggggagatatcaaagcaagacaggatggctgtttctctttctcacaacactgagaatactccaaaacttgtcttttctctctcttctggctttatgtggaaagtatgtttcctcaccaagacctctatacccttgttctcaaacaamttttaagcctaagaaaacaaattgtgtgttctctggggatgtgagcatcattcatttgcctgaattcccatctaagtttcatcccttcccttctatcaagtcagctaccatcaagctacgaacctgctccgtcgcttttaaacctagacacttacatgttcagggctgttgtcacatcattgacttcggcctttcccaaaagtcaataasagaaacaaatgacaaatgactgaattttagcaactgtgattcagagatcattttagagtctactttcccaggtctcatcttacctgactttcacaacagtcctgtaagttagagaatgcagtagtaattggaaactgaagcccagaggggctaattcatctgcccacatttccacagctaataaatgtctgygaaataaaactagagctagaattttctgtatccaaatgccatgcccttaccattgccaacagtgtgttgctgcatcatttgcaaaaactaaaattgttgaaaccctccatcatatgccatctggtgtcctttgatataagagccacaaaatcaagtgggaaaagtagattttggagttaaatcttccctcatagctccaagaatctgagcaagttattctttgaactcagtgtttgttgttgatgttgttaacttctgtcttgcagagtgtgatgagctaagaattaaattagataatacaattaggtcgtaagtgtaaagtaggtagcagagtgtatgacacacagtaggtcctaaaatgtttcattcccattttggtgtcctttgatacgagagccacgaaatcaagtgggaaagtaaacttcggagttaaatctttccctagtagctcgaagaatytgagcaagttatcctttgaacccagtgtcagtcacattttaggacctactacatgccatacattytgctatgaataattcattgctgtgttgtcagagaaaatggtgtttacttatttatttttttttattttgagacacagtctcactctgacgcccaggctggagtgcagtggcatgatytcagttcaccacarcctccgcctcccaggttcaagcaattccccacctcagcctcccgagtagctgggactacaggcacccaccaccatgcccggctaatttttgkattttttttttttttttttttttttttttagtcgagayggggtttcaccatgttggccaggctggtctcgaactcctaacctcagatgatctgcctgccttgacctcccaaagtgctgggattataggcttgagccaccgcacctggccrgtgtttattttttaagtacacaaggagaactatatccctccattcttcttttggcctggaaaaactgggtaaaaygtaaagctaggatttatgtgcacttgcagtgatgtttcgagtacagtttctcctctccacactcaactcttctttcttcactgtgcactttatctctctggatttttattgtaccttcactcagatccctgagcaggcagggcacacttttaaaaatccattcaattgcttaataattttgtgaacccttggaaagagtacaaagatagtatgaaatagtgatgtcatgtccgaaaccagagaagtgctccattttgtctcaggaatggcctatgcaggatggatgggggttggagaaggaaccccttttcccacccaacacaggtgtctctcaggactctgtctcttttttaagaaatgggaatccaaattctaaaataaagttayttcttccctctccttctaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggtatggcttctgctccgacaaccctacctcccctctaacctgtctcagcatgataccttcaatggcgccctcattaggagacacgagtcattgcctccatatttatcttacatttcggtgtacctgccatccatccaaacatcccttctacacaccatggaagtattacttagaatgttttagtgtcatcaattgggaaagatctttacttctagatttgtttgtctgttttcctgttttttagaatttggtttcatttagcataacaaccaggcttctcagcagtccgtgacttaggggaaaatgtaacaagtgtttgttcatctaccctgcatgtactggaagagataaaagttggaaaatagatcaraacgcacgtacactattatttttctcttcaaggcyggcagaaaaagcagccttggagtgggctcatcagtgagcaagcccctgagctgggaggtggaggttggatgcgtctgcattcccactcggygttgggaccctttccttatgctgaatttgccagaaggctgtgccgttctgggaggacttgcatcctggtctcctttttccttaaaaaaacaaaaattatccttttctttcctgactcaaaattattcaggatcattgtagaaaatttttataaactcaaagaagaaaatcacttataatcccaccacttaagatatactcgccattaatactttgaagtttctccttctatagattctctctgcagtggacttctaaaaacaaaaatagcaacccactgtaaatacctactgcactgtactctgcatttgttacactctattttgaacattttcttacgtctttggatattctacaacgtgatttaactagaacatctctaattttttgttctgatttaaataacactaaaatgaacatcctcgaagattagttttcatgcacatgcattatgattcttcttactggtttgtctcctctctgccaccccatcccggctgtccaccacccgcactaattagcagcctcaagtgggaccatatgactaagggccaaagaacacaaggggcggaggcttttccattttctgktttctttctttttgkttgtttgttttgtttgtttgttttgagacggagtctcactctgtcgcccaggctggagtgcaatggtgtgatctcagctcactgcaacctccgcctcccgggttcaagtgattctcctgcctcagcctcctgagtagctgggattacaggtgtgcaccaccacactcagctaatttttgtatttttagtagagacagggtttcaccatgttggccaggctggtctcaaactcctgacctcaggtgatccacccccctcagcctcccaaagtgctaggattacaggcgtgagccaacgcacccagcccttttcccattttctatctcaagccatgacgactggagagtgaatgagggaaaacttctaaggagacttgagccatgggaagaattaatgagggaaccagggaatgaatgaggaaagtggatggcaactggggcatccatcmccacctctgcagttcccagtagattctcagcatatgtgcaataaccaaatcaatgaataaatgcacttacctaagataaagagaagccagaccatggcaaagcacttactgagcatatgctgtgctcaaagcactgtggaggatacagaagtatataatacagctcccgaccttgagaacttcacactctaataagagtcaaggctgcatttctaacagtatgagtaatattagatcagaaggcagacacaaagtaccagagctgagagaaactagaaagaggaatttgaatgggcagaaagggccttgggcatgaaaggtgtggctgcaggagaggaagtagaaaagagtgaggtgtcctggtcaactatttaggagaatgcaggcccgcttcctgctgcagggagcaggctggaacttcccatgatgaaggctagaagagattttgtactagaaactccctcctggagatgataaatacccattggcctgggagggtgaaggtatgtcacctgcaggcaaagggacaaactctgccaccctctccatgctgttgggagggtgaaggtatgtcacctgcaggcaaggagacaaactctgccaccctctccgtactgttgtctagattttctgcacatgctggggctccctgtaatcttttccctttgcagtattttgaggcttgtagcaaactgctaaacacattttttcttttttgccataaataaagatttttactgtaaagctttcatagtagcgaaaaattggaaacaacacaaatacccaatgacagatttattgaataaattattatatggtcagagaaaataatactatataaccattttaaatgawgatgtaaatgcttaaacatcaatacagaatgttgtttatgaaatcrtaagtgagaatatatagtatttccttttaagcaagaacatttgcatgtataagcatgaaaaataatgaaaaactaacagttgttaattgggaggtaggattataactgattttatttttattatatctttctgtgtatgttactataaacacaytttagactgggcttctgggcacttaggcagttgtgcttctcttggtgccttttccccatttttttttttttttttgatttgcatgtatgacagttttcatgtcttacggggaaggctattgggaatcccactttgtagaagataggtatgctcctttctcttgcctgtccatcacagcttcaggcagcatttgtttctgtccctcttatgagagatctccttaacccatttatgcctgaggttgcaactttttgaattttgaaatcagaccttggtgatgaccttgagcagtargatataaataactcccacatgcttagcgttccaataatggaacactaggcataaatgagttccgtgcagctgggatgctttaccaagacctgagccacaagtgcatccacagcattggtgctgggagagaaaaaaaaacttcagcagagaatgtttacatgaaatgtaaatctgactggctcaagactcakatctcaaggaactgagtccttttagaaagaggaaagaaacaaaggaagaagcttgaatcaccttttccaacaccccgagttgttgtttttgagatgtcttaattattcaaaccttgcttgtcaaagtaastgattaaataccacaagtgaatgcaaaaggcaacgattgatacgtgatatggataatgctttgttctgggaacatgttgggaatgacctttcttgggaggacagttacctgtgtatgctagtgtagacatcagataagataaattaactatgtacttctccagggcattgttattttttaaaggaagttattcatctgctctctgcctccaaagagcgcacctgttgaataccagattattcaggagattctgaggacakgtattcacttgttattaattagggtcatttggattaaattgttaaagtttttaaagttcctagatgagggatatatcacctatggaagggtgaaaatatgataaakccatttaggaagctacaaaatgtgaaaattcctgtggacttggattccgaagttcaagcccagctctgcygtttatcaacagggctctgaggcacccactttacccctgcccaggacagagagtaagagttacaggcagaggggctgggagctgtaaaaccaggggccctaatgggacggcaccgtctggggacatagatgtrcaggataattcatgaaatctgaacctgaatctgaatgaggctcaaatcaaaagaatcttcacaatgaattttctgtgtgctagatcaaaatgactttgtacatcatccaggctctggcataaattactggctcagggtctaacgtagatcagcattctgagaggctgctgtcttggcaagaggaaagaagggctagctcttctttcttttactttttttctaacatttctttgttgttaatatttacattttctgtcttacaaagtctgcagggcttgaaattgcacgatcccttctcagtacccccttcagtgcggatgccagccaacttttgcactactagatttccaacttagatttttaacagtttccattacttacattttaaaaagtaaaaaaataggaaaatccacaataaaatttgtctacaagaagagttgtcataaatcttttaactatccacttacaagtagatttaaaacaattagaaaaaaataattaaccataaaactttgaaacacagggaaaaataaacactgaaacagtttccctctttttagttatgctgcagtaaaagaaagattaataactcaagtatccaaagtttctgtgttctatctctgataaaactgtggaaaaataagaggatttatttctaaaatttgtttggaaaggaaagatgcatctaacacagtaaggatgctatttctttttaatttcaaggaaataattttcccttaaaaattaaaagtgaactaaagtctaccttcctctgtgtctcctttgaattctgaaaggccgatctgtattctgacatttaagtagtgttactatttcacrcctaagtagctctagatcctataggaacagctctgtctctgggtcgttccctcaggttggatttgagggcaggccgccgtggttttgcaggcctctgaagagaggcctcccagggtgatgccaagaggcagaacgctagtgttcctggattcacatcactgcccttgactcccacactcccaatatgcaccagttgaacattcttggtcaatatcactttgaaatttttcttttakgaaaaagaaaactgagtttcactttctattcatagaacacacaaagctctacttccggttatggcttcagggcatgagtgtgtgagttactttgaacaagtcacctaacatttctttgtgacactggttctccttttttgcttcctaaggataacgtgaaaaataataataataacaataatagcacttgcagagaagtttggatcttttttggagaaagtaccatactaactacaagatattattatcatttaaaattaaaaagaaaaactccttgaacttgatactttttaaaaagtatgtcatcctggtatttccatagttttaaggcaaaatccatctaagaaagtttttaatttcaagcattttattcagaaactgcttcatctgaagctctcaaaaatgctgcaatccatgaacctttcagttgagctaggagccctggaaattaccacaattgtagcaaagaaaagaaaacccacggaaaccacatccttccaaagacgtgtccctgcactaagacaagaattaacttttcatgctgcccccatctgtagtgacagataagcctcttttctttaacgtcctctggcggcgttctgatcctgagaacgcttacacgttgttatttcagaaactggggatcactcagacattctgcaggttcccctgctatgtaaccaaactgtgatttggcaaatgttagattttatagcaaatttacaaaaatgagtcgatttacagctgtcaacctgaaataatcaaaaaggccagaatctaatttaaagagcatttattcaaactcaaagtttgaggatggcccacctggaaacaccccaaaagaatgaagtcagagttgtaaaggagggaactttagggtttccatagggagagacasaggcatttttagcaggattacattttttcatacaaggctggtgcatagttccaggaacttggttacaggcagtgtttctttttgggaaagggacatttaacatcttttacagagtgtgctatagtcatgggttttctgtcatctggtctaaggaaaataggacaaaaaaaggaaaaggtaatctttaacaagattcattaattaaaaaggcaggaggcggccaggcacggtggctcacacctgtaatcccarcactttggaggctgaagcgggtggatcaccttggggtcaggagtttgagaccagcctggccaacatggcgaaactctgtctccactaaaaatacaaaaattagccaggcrgggtggtgggcacctataatcccagctactcaggaggctgaggcaggataatcacttgaacccatggggcggaggttgcagtgagctgagaccacaccactgcactccagcatgggcgaaacagtgaaactccgtctcaaaaagaaaaaaagaataaaagaagtcaggaagtgtttgtccctgacaattgtttaattctctctagtcattgtacagaacaagagaaaaaaggaagcaagttaatctataatctgagaaacagaagttgtaaccatatgtgactcagatcacagtcgcatctctctcaaggcgtaaaacgcattttaggaattctaacaccttttaaatgttatttattttcacacagtaatttatgggaaattaatgttgcactcacaatgtttccttacagttttctcgtccaaatacacaggaaataacgggcaatgagtgaatacatattcaggaattcttggactaaaagaacaagacactcactcagtgcatctgaaatgccgcatctttcctacatgcctgctttttttttgtttgtttttttctgagatggagtctcgctctgtcgcccagcctggagtgcagtggtgcgatctcggctcactgcaagctctgcctccygggttcacgccattctcctgcctcagcttcccaagtagctgggactacaggcgcccaccaccatgcctggctaattttttgtatatttagtagagatggggtttcaccgtgttagccaggatagtctcaatctcctgaccttgkgatacacccacctcggcctcccagagtgctrggattacgggcgtgagccaccgcgcccggcccctacacgcccactttttaagctcacagatctgttctcatcttgatgtgactctgtaatattcttccaggctcatggcccatattatctgcccattcctttgtcagccattctcacaaagtcccaaaagtattgtcaccagcttcccagaagacatgagcatttgacatctccttcaagagagtgcctcaggaaagtgcatgccttctgtgaatctactatccctcttttgttttttgttgttgttgttgtcattgttgtgtttgtttstttgttttgaraaggagtctcactctgtcgcccagattggagtacagtggaacgatctcggctcactgcaacctccatctcctgggttcaagtgatcctcctacctcagcctcccaagtagctggaattacaagcgtgcgccactgcgcccagctaatttttttttcttggtattttagtagagatggggtttcaccatgttggccaggctggtctcaaactcctgacctcaagtgatccacccacctcggcctcccaaagtgctgggatcacaggyatgagycaccatgcccagcctactctccctcctttgaaaccttgctgacaaactacctactctataaatcacgctcagatacactaaatcctacttgtcattcagacgctcaggcttctcagcttacgtgacccagaaagatgattttgctcctgtactgctgggtgtcttctgtgacttctttcatatgttctgtttaaataataccttgtctatgtaaataatacattccttgataccaagatgcatgtttcgctcttttcttttgtttcatttgcccgtagagtgctagataatgttcaggggctgggcacagkggggagcggaagagaaaaagaaagataaatggtctgactgtagatcatactggctaactcaggtgccaggaaggctggtcccgaatagaactgcagaggagaagtctatctttgacaaaccctcttcccacccctctctgacctcctgtttcattattttccccttcatcccagagttcacatgatcttgtacccactgtagctatcaggtctctgccttgattttttttttttttgcgacagtctcactctgttgcccaggcggctcaatacaacctccacctcctgggttcaagtgattctcctgcctcagcctcccargtagctggggttacaggtgtgtgccaccatgcctggctaatttttgtatttttggtagagatgggatttcaccatattggccaggctggtcttgaactcctgacctctagtgatccacccacctcaggctcccaaaatgctgggattataggcatgagccaccgcgcttggcctctgccttgatccttgatggcaaaatcgttcttctccatctccttgtctyycccccttaaaacttctgtcacttcaggaacctcttctccaccaccagtcttagagaaatatctgataaatagcatagagcagtttaatatgtgttgttcctagcaacgatttcttcctaaagtggagcagagtggagtttccttattagacccaacattacgttgtatttgaggtgattacagttcccatcctgaggaggtgacacgcatgggactcttcaggggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaaaggatcatatatttaatgtggtgaagagttgacaatcaaaaactgagtgtggaatgtgtcatggaggaggaacagacaatacagtgtgaaggagtgagtggtggataggcagattcagtggtgatacagaaatcttccagaaagagttttcagaagatggaagctcattatgactgcagagtgtaagggatgagaatcatgggaaatgcttgagccagagatggagaaaccagacaagagggagactattcaggttgtagccttttcagataggcttctttcacttaagaatatgcatttaagggttcttcttttctttctgtggcttgagaactcatttttcattgctcagtaatattccattgacaactaatgatttgttatgttcttttgttttccttawaatgacagactccatggatcaagaattttagagtagggaggggtggtagaggttatcaagtcagatcccctcattttgcagcaaaggaaatggagctccagagaagataagcctagctggtcacaggagagtgctcttttctgtggtcaatccaaaattattagtaaagttgagacttcaagatacctaaacacaaatccaactcacaacttatttaattggaaaattgttcattccatgtcctaaaccttagacccaagcaagaggggttcygcccagcccctcacttagaatcctccctttggcctttctcaaaccacactccttcctgtgaagccaagaggtcgtctctgttcctaaactactycccaggacctcggaattccatacctaaacagcctcaagcctgtgtagacatctccctaggttctgtccttgaaaggggcaggaggagactttcccgatatggccaattaactggtgcagaattttgagggatcctgaatttgtcacgatccttcttggtcattatgaagttatatttcccaagagacagaacatataggaatgtagagcatatttaattgaattgttggtgagcttgattaataacacttaaacctggggacccacagtgtggggcctccctctgcacactcgctccaaatcttgcaaaggttggggctgtcctttttctgattataatgcaacttaatgcttttcttccctgtgtgataaataataacaatgtatgtgataaagttaatacataaggagttcttgctatatgccaggcacagggytaaatactttatatgaattctttcatttaattttaaatatgaacgatagctcccctttcttcttcagagcagaattcccaactctttccatcggctgtcctatgagatgtcccaaagaagagttgaattctatctctggttttcatcttgttgtactacagtcttcgctgttgtaacatttgttacgtgtccttaacatatgatactttgaaaggtgtgatggtaaatttagatgttttgtcataaatattttgatcttaattttatttattttgcagagattgcaaatattctcttgtgtaaaatttattacgttggtttactagccttcggagaaaaaagatacctcgaaaaaaatgactataattattcttttccttcttttcccatcttgtttttctggagagggagtctayaaatctgatcttatttgcatgatatttgccaagttctcagtgcatttacaaaattaactgttattagtctgataaaaatmatgagtttatttctttaatgctataaacctgtcattcatcctataatatatgcacatttgccagccatttccttgtttactcaatatttgattagctgtgttgaatagtcatcacaactaaacacttttccattctctttattctcattctctcctttgaaaagtgtaatcactgtaagaagaaagcagtgtagaagctaggttgtattaaataacttttgaggccacttttacaattcaccctttactaattctagaatattcacaaaatgtcctattcctccctttaaagaactatcttgtgttttaaataatgatatattttgacagctctaggacctttatctgctccaaatgatatttgtgtatgcaaacgcagtcctatgagaattatacaactgattttgttaaatctatcactttgatcttgtatttaatcatcattttttttaagacagggtctcactctgttgcccaggctggctttgkactcctaggctcaagtgaacctccagcctcagcttcatgaatagctgagattacaggcatgcacctctgcacccaacttaaataccatttctttaaaacatcaataacacaaacataagagtcatacagctttgattacccacctatctacagaatgtcaacattgtttattgccttcagttgtctggaaatcacaacaaagctgtaggtaatggtgactctctcattttcatggacagggttcatttttcagaggaggaaaccaaggccctgtgatggtgggatttacctgatcacacagctgattagcgacagtctcatttctcacagactagaatttccattcgacagatgctttgccaggagttgttgacagtcggcaagactgggacgcgtttggcatgtcccatcccccaatgccatcacagcttcaattctcacccaccggaaagaatcatttgcctcggttaatgtattacccgccataaagacgtgaggtctagactagtaagtgacatttacaattaacccaacacaggccacattctctccctccctccctccccaccatctctctctctctctctctctctctctctctctctctgtctgtctctctctgtctctctctctctctctgtctctctctctctctctctctgtctgtctctctctgtctctctctctctctctctctcagcctgcttggtatcctctctcagcaggtggccagaacctaaacggcagcccaggagggaatctaattctgttttcttctttctttcgagagccatcggccagagaactgttcatttgcttcttctgggaagtatttgctggtttttggattggttttggttttgtctttcctggcttttaaattgcttcctagaaggacagctgccatcagttatcaattgcccactgaggaccaatgcagagattcatttccacacacactattttgtttaatacccacagcaaccctaggaggtaggagtattactaccccatttcacaaactaaatgaagctcaggagaggttaagtcacgtctccagagttataaatagaggggctttgaacccagggctgagtaaggatgaagcccacattctttgcaattactctgagtctcattcttcttggtttgtttctatctatgccagcccagagtctttccagcaggcagacacttctttttgcttgcggttctgcagaggttctagtcagctgtgggttgccttcaactctgagctctccttccccagctgtttatgaaagtttgagcctattatatttgtatttaccttttatgatgggattttggattcagcttttaaaaggcttatccatccctcaaaatgtgctcctcaaaatccaaacctctggacygtgtagtttgtatgtgcatacatttgtgctaattttatcacagagcagaacagatatttgacagatttattgtggagcctgcagttctcttgggagggttaaatgtggggcatccaacatactataaatctccattgctgttaattaataatcactagtaacgtagtcttcttctcaccctcatgktagtaaacactgactgtgccctgtgatctcttagactttaatggccaattcaacccccccaatgctcaccactagtgtggcgtctgattcagacctgagaataggtgggaaggtgtgtggaatgcatgggagtggggctgaactgttgcctccagtcccctcccaccactttctccacatctaaattgacwgtgttaaattctgaaatgtcagcctttctaggaatttgtaagcatccaaacacttagaagaaaccgttcactcaagcactgttggaaatggtttcgctctacactttcatacgctttgctctcgtgactacttaaaagaagattccacctttgtggcttgtatagggccattatagtttgagtaaaaagctgaggttagaacagaagctctttctgtggtgctgatgagagcaagaggtagcatgagaaagcaggtgtgtgcaggcaaagccaatgacgactctcaaattgggtttgaaatctgtgttaagtcatgatttatgtcagctgagaatttgggcctgtccagaagagaaaagggtgggcttcacttaaagatatatggaattagtaaatcagatcggaaactaacattgaaaaaagacggatgcttaccttgacctggattattgagataattgccacaatacttggtttccccattctgtggtgaccaggcaaggagtctcactgtcagaccagaacaatgtttctactattacctcctatgccccacggcctcggttgggttcacatcaaaacrtaaaggttaattctgttaagaaaccacccaggtgagactttcagatgcaaattcatgcccagacgcaccgaaggtcctcacactttatggattactgattctgtgatgcattacaaccctttaaaaaatcaggtttctctaaagtgttataaatacatttattggaaaaaaaaattgtctcacatcattgagttgctgaggctggttacaatcctggctgatatgcccaccacagcctgaagaccacccagccctacttctgactgtggccactcgagggccccagctctactgacatacatcatgtcctctgccagaagaactccgtcataaactgtggcttgcctctgccatgagttaagtcaggactggagaaaaataaggttaaacttgattgcaagcttcagggaggaatgactgacatgacccgcccactccccccacgccacgcccacagaatatgctcagtagctaattactgagtgttgagtgaatgaatgttttcaagctccgcccttggagtcagagaccaaaacacattctccttatcaccctgcaccctgtcactttcaataagtatacaatcggcacatgctaagtgccctaagtgcctggcaccatcccattgtctggccagcaggtcaactggactctcscttgtgcccsccgctcatctgctgggttgtaacacgcaagcatctagatgccacagggcatcccacctagattccccaggcttccyggggctcaaaaacatagattgtttaaatgattttgacagtcttctgataagtgatttcacaacagaattagttcccctgaaatgatctaatccatttaaaaagtagtcctccttgttgtattttctctaaagagctaaaaattggaactgtgactgggtatggyggctcacgcctgtaatcccagcactttgggaggccaaggtgggcggatcacctgaggtcaagagttggagaccagcctggctaacatggcgaaaccccatctctgctaaaaatacaaaaattagctgggcctggtggtgcatgcctgtagtcccagctactagggaggctgacgggagaatctcttgaagccaggaggcggaggttgcagtgacccgagatcacgccactgcactccagcctgggagacagagtgagaccctgtcttggacaaaataaataaataaaaatgaaatgaaataaaagttggaattgttttgtttttccacaggaaaacctcttttttgtgatggagtacctcaacggaggggacttaatgtaccacatccaaagctgccacaagttcgacctttccagagcgacgtaagaggctttaaagggtttgggagttttccactgttcttgtcagttcttgctggtttttttttccttttttcccacttggcatgcctgaatcccagggccaggtgaacccttgggaatacatcgagcaaggcgacagttttcccaggttgtgaaactgaaattcgtgtcagtttggtttcatttctctgtgatttaaaactaactacttagtttcttaaggaaccatcccgattcatcaggcttctaactaacctgagcacagaagcaaatatgtamcctttggaaaggaagcagtgaaatggactgcagacctcaagggtggtccccagggatggagcttrtagctgaggcatcttatggaaagcctgatgtggaggcataaagctttagggagcaggaagaggcacttagtccatctgagaacaaagcttctccttcctagtgccggcagcctgagacacctggagacggggcagsctgtgtgtacctggtgggactgcacctgcatccacagttctcaccaccactcctgcccatgctgttccctttgggtcccacttcctgctccccatgacatgcaagtaaaagaaagctctgccactgggctccttggaaaatgatgagtacatgctagcttcctttgctcagcgctcaataatccctccctcccatctgcatgaacactttgagtggtttaggttgaagtgggttgagaaatggatttggtccgccagcttcttaaaatccctggctggaatggctgtttatcacatctagtgggtagcactctgctgagatcattgctctgggaaacctcagcaatgcacccagaggtaattttactggatttctgcagcagagaaatcatcgggcatttttcatgccggaaagaattcacttagtccactgtcgtctccagccagcccggacccacgctatccatcctgtcctaaatgccttccaggaaggagaattttgcattcttccacaagatccagcaagcttcccttccaggaagctatctcttatatccgaccttaatcccaccagtgatggggtaaactcatttcctttaaccttgtcaccattgaagatgaagtgtaacttatcttgcatctgctaatatcctcttttccacctcatgggctgtaagtgttgcccaggctaaaggttctcagtacgaaaataaaccagctagttctattcagaatggtgcatacaggtctatgggtgccaaccagagtttaaaacaaagggagaaattatttgcctattatctatactattacttttttttttttttttgagtcagagtcttgctcygtcgtccatgctggagtgcagtggtgtgatctcagctcactgcaacctctgcctcccaggttcaagtgattatcaagcctcagcttcctgagtagatggggctacaggckcccaacaccatgccctgctaatttttgtatttttactagagatggtgtttcaccatgttgcccatgctggtcttgaactcctgacttcaagtgatccacctgcttgggcctcccaaagtgctaggattacaggcgtgagccaccgtacctggcctatactatyacttttaatgtctgtgtatgttttattagcaatagcaaaaacaacaaaaaaaatgacaatgtgagcattattgtttaaaatataagaacaagtactagatacaggcaggactcacttaagatgccagctctgttttatgctgttaggactgaggctggaggtgtctgagcctctactttcttatgtgtagaatgaatggacaacatcttccttgttaggattaaacagagttatgtgtgtatgccatttagccatacacagcatgtcagaaaaaggtcagtctgggtttgggattttatttcgttccatgacaacattcatgttgaaccttggttctccttcccccaggttttatgctgctgaaatcattcttggtctgcagttccttcattccaaaggaatagtctacaggtaaattttgckttgtggaaacaaatgctaagatatcggctttcctggctcagttaatttaatcattgcaccgagtgctgtgagacagcccatgtgatttcctgggagtaagctccacacataggtctsctgcccacartgattacatggatgatgacttacaaccaaggaagacattccagtctcaacagcaggaaagtgctgagctcattctgtcctttatgctggttctcacttgaattccttctttcaccttccttttcccattttcactgtcctgttttctctttcttatcatwccttayggtttctttctcttttgtccccttcatacctcttatttttgcttgtctttgctttgagccacctakaaatgcttatggaattttcttcttctctgctgtatgacatcatttcacgttcttctgtccaagctcttagattgacactattgtatctcaatctcctcacttcttttctcaaaatgtagttggcacttatttaacatacaaacctttacaagcttactgtcakatttccaactcactgcagattaggaggaaaaatagaaaggaaaaaaaagaaaggatctagtgaggaggatggctgagctgctggagagcagataattagtattgaagctttggtgcttacagagtgtagaattcacttaacaaggaaggatctctccattttctgagggtgcagtcaagtgagggttgccctatttggagtcacacaactaaaggcttagaggaggtttgagaagtaagtattcttaagcagcctctttgaatgtaattttttttggtctwtctacaaaatcatagattaagaatctgttttataattttttaatcttcaggaaattgagaaatactcaccagaatattatttwaaaactcttagcagaatttttttaaatttttctttatatgtgtaaggcctgcaatgtatctaaaatatttttgtacctaggcactgactaaattgtgtggggtggatggatagatggatggatggatgatggatgagtgaacagatggttggatgaatggatgaacagatatttggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacctggatggatgkatggataaatgatggatggatgaggaatggatgaacagatgggtggatggatgatgtatggatgatggatggatggacaacggatggatgaacagatggttggacggatggatggatgggtatggatggatgggtgatgggtaaattgaacagatggttggatggatggatgggatggatggatggatggtgatggattggagatatggatggatggatgggatgatggatggatggtgatggatgggtggggagataaataaatgaaaggggctgggcacagtggctcacacctgtaaatcccagcactttgggaggccaaggcagatggatcacctggggttaggagttggaaaccagcctggccgacatgacaaatcctgtctctactaaaaatacaaaaattagctgggtgtagtggcccttgcctgtaatcccagctactttagaagctgaggcacaagaatcacttgaacctgttaggcggaggttgcagtgagctgagatcacaccattgcactccagcctgggcaacagagcaacagtccatctcaaaaaatttaaaaagttaaaaaaaaaaarggggaagtaggaataaaaattaggagggactggagagagagagagacagagatcttagactggaagggaccccgtgaaacctaaacccacatgcctcggggcattttatttccctgtgtcacaaagcttctttctatcatgtcaccatgtaaattattaacactcagaacaaaaaaaaaaaagcaatagatgtccataagtagctttactatcacaacaaattgtacccattttcgagtcttaccctgcccatgcatggaagttatgttctttaagccttcttaggcaccaacaagaaaaaaaaatgagtttattttttgtgctcattaggttgcaggagaccctwgaaagtcatcatcaaatagttataactgaggataggtcaccagacaagtatgctggctttaaaactggcctgctgcataataagaaataagttgccttataataagttgaatagtaagaaattattcaactgtctgtgtgtaatttgactcacctaaacttttaatttggcaactgaattaacaaaaggattcaattcatttctttcttttgacctcataggataataattttctgaatttgttcacaaaactgatacattagttttgaagggctgccataagaaattaccccaaatttggtggcttattctggaagctagacatttggaagcaagatgtgggcagggccatgcccccmccaagccctcgatttaccagcctctggtggctgcaggcattccttggcttgtggctgcatcacccagtctctgcctctgtcttcccatggccttctcttgcccccatctgtcttttctaagaacacttgatggatttagggcccacctcgataatcaaggataatctcaccttgatatctttaacttaattacatctttaacttaattacatttggaaaaaaagaccctttttccaaataaggtcacatctacaaggttctgggggttctgacatgaacatacctggacatawcttctgggggccaccattccacccatacagctgatatcacagaccatgtgtgctctggatgtgcaggtctttgtcaagcatggcagtgggtactaaacatagagaagtcccaacccccagaaacctgatgagccactttctggggtttcttcagaggtagaatggattgatgatgaatggatgaacagatgaaaagacacaagctgtacattcaaaaaatgtccaagtgaatgttattccaattaaaagtgcaagarckgaaaggaaaaaatatatcaccagacttaagtaggggagatggcaaacaaaaattcttctgtgaaggtagactttttagagtggaagaggctttgcagatggaagaastgactccaggaaaggcacagcaataggaaaatggaggaatattcaacaggtgcatccagcttcaggggcaaggctgctgttggtcgatgaaaagcatgagatgtggagaagcaggtgtggtggcgtcactcaccatctgccagaggaaccacaaaatcgacggcatcttcaaagatgatgtaagccctggtttgggtcaaatgtaaaaccacagagccggraagtatgcagatgtggaaagaagaatctagaacttccaatcttagagtattagaactaagaagaaccttaagwttatattttattgacaataaaactgggcccaacccatgtgtttgaagccactttcaatgctttcacrtgattctcattggacgttacaggaccccatgagacaagcaaggcaagtgtcatggtccctgttccttggatgagtcttggaggctgccagaggggaaatggtgaggcggagccagccggccgtaatgctgggattgggaagccaactgtgatgcccactccacctcttccaaatagaaaagctttgcctccgttaacctcatgatggaatgaaagggtgcccctggatgttctcttctgcttgatgccatgatggcctgcttctcctctgacagatgaaagcttgcagagacatgcacaggctgtggactctgaagttctcccctgggtcctgatgccccatagggtgtaagcatgacatgcctcagaataccctgggcctctgggttctctgccctctccagctggctccaggggtcctcactggtcttccttggcactccttcctcacccccatggggggctggcttcacatggcagcctttcagaacctttcccatattgacctagatccctcagagctggccagkcgcagtggctcacgcctataatcccagcattttgagtctgaggcagaaggattgcttaatgtcaggagttcatgaccagccttggcaacrtagtgagaccttgyctctamaaaaaattttaaaaattagccaggcatggcgatggcacacatgtggtcaagagtctgaggtgggaggactgcttgctcaagaggttgaggctgcagtgaactgacatcatgccactgcactccagcctggatgacagggaaagacctcgtctcaggggaaaaaaaaaaacctgatatcaagggaagcacctgaattatctttaaaaaatcaatttcacaagtacagaatgagaagaaactgggataatggcacttcataaaggaaagcagaaaaacacctgaaggttttagtttacaataaactcaatattgggcattactgtgatgaaactatgaaaaatatggtgcaggatcttagtccaccrtggcaaaaggcaagaggatggtaatggagctctgggtgccgctgtaacctgcaccaatcagattgtctctctggaggattctggcttcattctgagccaagtcagtcragaagaaaacggacaaattcaagatatttggaaggtagaggccagaatgtttgccctycatccagtttcccccagtggccacatctcatgcagctgtggtacaaggtcaaaagggtctgaaaaccacatcatgaggagcgaagtccctgatcttggtgagagaagagaaaacttgatgtcatttttttcaaatatttggggtgtcacatatggtaacaatagaaagcccccttggaccaataggtgacatcacatggaagcaaagttcggttaattgttttttaaaaaatattatcagttacatttccctaagaatggaatgggttcttttaagaggatactagttctccaaggaaacagaagtttgttggcatgacrttctggcgttggatggattccggttctcaaggggttcagtattagttaggaacaaacttcatcaactggacttggaattaggtgcagtataattcattcacaaatatgtagaaaatggcatacagtaagtatattttttaggttttcctccttcgtcattaccctcaggaaagtcctgggatcaagggtctccaatgggtatgggtgctctgtcctccttatactgagctgcaccccttggtaaatcagagaaagaatccatagcagccagcgtgcccttgcagaatctgctttgtctacaccccacttggtgtgcaagtggatagatacataagcgcctctcgtgagcccctctcaggctgcaatgagacaaactccctcgcctcctatggaattttatgttaaccaaattatattgattaatgtgasatttgcttcacttttgtttttcagggacctgaagctagataacatcctgttagacaaagatggacatatcaagatygcggattttggaatgtgcaaggagaacatgttaggagatgccaagacgaataccttctgtgggacacctgactacatcgccccagaggtaggaatgcagtgacaggctgctcccacctcaccatgccctggccacatgccattgcttctttagcccctgaaaakcagaaggttttaaatatcttcattcaagatttgtacctgttttcttaagtatctcataaacgccaccatgcatgtgggtttctattattattttgtggggagcgctacttttacaaatcacatctctccaaggcttgcagagtttggcatttcctttcccccagccttaaaacatattcactctgctcagacctaccagaaggaacagctagtgaagagccaggtggagcaagygtccacccaagtcaagtggtgaaactgtggggtcagaagacctggactgagtttctaagccaccactgatgtaagcacagagtgattgccaaagtctcactgacttccatttcctcttctgtaaaatgggtataatgctgatgtcattgtgttattgtgagcattagatgagaaagagtgtgaaagttaaaactcacccctgcccccattaaaaaataagaagaagacactgctgtcacattctggacacacaaagaagtgacatttgcacagaaggcatccatcaattcaactaaacccacctccccccttttcacagaatcctccccagctgcccacccagggagattagtgacacccctcccacttggtctttcccatggcacagcacttgttstggttgctttttcatcttcaaatctccctgcatgactggatatttgctctgcagtcatggacagattcatattcactttttaaaaattttcatttcgaaataattgtagattcacaggaatttgcaaaacatagtccagaaatatctcccaactgtgcccttcatccagtttcccccagtggtcacatctcatgtagctgcagtacaatgtcaaagccaggaaactgatgtccatccaaagtgtacatggtgctatgccatcttctctcatgggtagatttgtgtgatcttgttcacttttacatctaaggacctagtgcaggtgttggcatattaaggtgctaatagataccttctagaagagtaaatggatgaactaactaataaacgtgtgattggagatggttgtttgataaagactctggcagacctctgatttcctgggtaaaattattcagcagcaagttcctgtcattgccaaaggagttgtggccatctgagtcctrgaactatgtagctttgccctgtggttgggtgatatgtaatttgaatttagccttggcttctattccatgaggaatgatgtcttttagcttacatggcattgttgaactcacagarcgaggcttattgattaaataactttctgatcgtagaaatctatgtttcattcagtttggcacagatacaggttttgatgctataaaccattttcatttgaagtgaaaccaaagctcatcaaagcaygagtgatggggacttaagaggacggactcaactcaattactgaattcccctttgtaacaattctgaaatatgcccaaatgcactctgctcagaccaccctcactgccatccccagcagcagtctcctttgtcactccctcagcctcacctgagccatctcaatttctttcctcttcaccttgcaacaccttggtgtggctgccttactctgatgtattcctgtctacagattttgggtgccgggtcttttccmcggcawaccttccttcccgatttccatctgcttcttgcagaatccggcttccacagcttgcttctctctgcagcttcactcccttcttttcttttacgtgtgcttgtctccacgtgattcagtgcttggtcctcttctcttcttactctacatcctycacgagcaacttcattgatgactgtggtcttcgctgtagagtcaatatggcccacctgcacttcttcctgctgcagacactacgtccactttcctgcttgagacctccaagtaaatgcatgagtccttcaaagacagcaggtccaaaactctctctgttgaacttgctccctacttcactctttccttttctttcttggtgaattacatgtcatccatccagtcttctagagagaaaactaggaattatacaaatttcccctttctttcttacccttcaaatccacccaaacaccaacaccttctataattggaccctctcatgtccattcactsccctaaacttgtgactgaattcagactctcccttgattccttctccaagctcaaacaaatccccttgatccagctccgcccagatctccaggtcctctcgcccttactgctgttaccctagtgcagaacatgagcatctcttgcctggctcttggtgacacccttccatctgctttcctcccttatcatccatcaccagggcatgctctttacatatcttcatgccttttgatctgttagaaaagcatcsccaagatctgtctatttatatatgaatcatatacattgtcaccagctaagatagactgtgtgttatcaatgcctaaaaaggaatatgatcaggttatactaacaataatatatagtttaaaataactaaattgcattaatttatttattattattatactttaagttttagggtacatgtgcataatgtgcaggttagttacatatctatacatgtgccatgctggtgtgctgcacccattaactcgtcatttagcattaggtatatctcctaatgctatccctccccgctccccccaccccacaacagtccccagagtgtgatgttccccttcctgtgtccatgtgttctcattgttcaattcccatcyatgagtgagaacatgcrgtgtttggttttttgtccttgcgatagtttactgagaatgatgatttccagtttcatccatgtccctacaaaggacatgaactcatcatttttttatggctgcatagtattccatggtgtatatgtgccacattttcttaatccartctatcatttttggacatttgggttggttccaagtctttgctattgtgaatagtgccacaacaaacagatgtgtgcatgtgtctttatagcagcatgatttmtartcctttgggtatatacccagtaatgggatggctgggtcaaatggtatttctagttctagatccctgaggaatcgccacactgacttccacaatggttgaactagttggcagtcccaccaacagtgtaaaagtgttcctatttctccacatcctctccagcatctgttgtttcctgactttttaatgattgccattctaactggtgtgagatggtatctcattgtggttttgaawtgcatttctctgatggccagtsatgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcagatgagtaggttgcgaaaattttctctcattttgtaggttgcctgttcactctgatggtagtttcttttgctgtgcagaagctctttagttgaattagatcccatttgtcaattttggcttttgttgccattgcttttggtattttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagataagyggcattatttctgagggctctgttctgttccattgatctatatctctgttttggtaccagtaccatgctgttttggttactgtagccttgtagtatagtttgargtcaggtagcgtgatgcytccagctttsttcttttggcttaggattgacttggtgatgcgggttcttttttggttccatatgaactttraagtagttttttccaattctgtgaagaaagtcatygrtagcttgatggggatggcattgaatctataaattaccttgggcagtatggccattttcacsatattgattcttcctacccatgagcatggaatgttcttccattggtttgtatcctcttttatatcattgagcagtggtttgtagttctccttgaagaggtccttcayrtcccttgtaagttggattccyaggtattttattctctttgaagcaatcgtgaaygggagttcactcaagatttggctctctgtctgttattggtgtctaagaatgcttgtgatttttgtacattgatttygtatgctgagactttgctgaagttgcttatcagcttaaggagattttgggctgagacaatggggttttctagatatacaatcaygtcatctgcaaacaggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattccgtatgatattggctgtgggtttgtcatagmtagctcttatgattttgagatacatcccatcaatacttaatttattgagagtttttagcatgaagggttgttgaattttgtcaaaggccttttctgcatctattgagtaatcatgtggtttttgtctttggctctgtttatatgctggattacrtttattgatttgcatatattgaaccagccttgcatcccagggatgaagcccatttgatcatggtggataagctttttratgtgctgctggattcggtttgccagtattttattgaggatttttgcatcaatgttcatcaaggatattggtctaaaattctcttttttggttgtgtctctgcctggctttggtatcaggatgatgctggcctcatcaaatgagttaaggaggattccctttttttctatttagtggaatagtttcagaaggaatggtaccagttcctccttgtacctctggtagaattcggctgtggatccatctggtcctagactctttttggttggtaagctattgattattgccacaatttcagatcctgttattggtctattcagagattcaacttcttcctggtttagtcttgggagagtgtatatgtcraggaatttatccgtttcttctagattttctagtttatttgtgtagaggtgtttgtagtattctctgatggtagtttgtatttctgtgggatcrgtggtgatatcccctttatcattttttattgygtctatwtgattcttctctctttttttctttattagtcttgctagcggtctatcaattttgttgatcctttcaaaaaaccagctcctggattcattaattttttgaagggttttttgtrtctctatttccttcagttctgctctgattttagttatttcttkccttctgctagcttttgaatgtgtttgctcttgcttttctagttcttttaattgtgatgttagggtgtcagttttggatttttcctgctttctcttgtgggcatttagtgctataaayttccctctacacactgctttgaatgtgtcccagagattctggtatgttrtgtctttgttctcattgatttcaaagaacatctttatttctgccttcatttcgttatgtacccagtagtcattcaggagcagattgttcagtttccacacagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgctgaaaaaaatgtatattctgttgmtttggggtggagaattctgtagatgtctattaggtctgcttggtgcagagctgagttcaattcctgggtatccttgttaactttctgtctcattgatctgtctaatgttgacagtggggtgttaaaagtctcccattattattgtgtgggagtctaagtctctttataggtcactcaggacttgctttatgaatctgggtgctccygtattggatgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacrtttaaagttaatattgttatgtgtgaatttgatcctgtcattatgatgttagctggttattttgctcgttagttgatgcagtttcttcctagtctygatggtctttacattttggcatgattttgcagcagctggtaccagttgtgcctttccatgtttagtgcttccttcaggagctcttttagggcaggcctggtggtgacaaaatccctcagcattttcttgtctgtaaagtattttatttctccttcacttatgaagcttagtttggctggatatgaaattgtgggttgaaaattcttttctttaagaatgttgaatattggtccccactgtcttctggcttgtagagtttctgcyragagwtcagctgttagtctgacgggcttccctttgtgggtaacccgacctttctctctggctgcccttaacattttttccttcatttcaactttggtgaatctgacaattatgtgtcttggagtygctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagacacagatttggtcttttcacatagtcccatatttcttggaggctttgttcgtttctttttattcttttttctctaaacttcccttctcacttcatttcattcatttcatcttccatcactgatactctttcttccagttgatcgcatcagctcctgaggcttctgcattcttcaygtagttctcgagccttggctttcagctccatcagctcctttaagcacttctctstattgsttattctagttatacattcgtctaaatttttttcaaagttttcaacttctttgcctttggtttgaatttcctcctgtagctcggagtagtttgatcatctgaagmcttcttctctcaactcgtcaaagtcattctccatccagctttgttccgttgctggtgaggaactgcgttcstttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacaaacaggaccctcagctgcaggtctgttggagtttgctagaggtccactccagaccctgtttgcctgggtatcagcagcggtrtctgcagaactatatttattaatactacaaaaatatctatgcttcatcaaaataatgagattaaatgactttttaaaaatcttggttttggccaggtgcagtggctcacacctgtaatcccagcactttggtaggctgaggcgggtggatcatgaggtcaggagatcaagmccrtagtggctaacacggtgaaaccccgtctctactaaaatataaaaaattagctgggtgtggtggcacgtacctgtaatcccagctgctcaggaggctgaggcagggcaattgcctgaacccgggaggcrgaggttkcagtgagccgagatcgtgccactgcactccagcttggtgacagagtgagactctgactcaaaaaaaaaaaaattaagtgctaccttccctggccaggccacactgtgcctctctgccattgcacatccttggtctgtgaccctcccctcaaacagtcaccttctccctaaagttgccaccggctttaggaatcacctgctgttcccttccctgtgcaaccacagcaccyctacatccacctgaccaatccattgagcttctccccatcagggaccatggcttatccactcacaggctggagcagcagccctcagctccttcctgaataaacgaccacacaaagtcaaacaccctaaaagttcatctctaagtgtatactgaattccccacctctgggcgtcttttgttaaataaccctccccagcttccccctactccacctggaaaaatcccacccctggtcggaggctgccctcccaccatccacttggtgaagttttctttcacctcactcagttccccattgccccttttgccctcaaaaaccaaacaaaactggagctgtgttctccctcctcagtgccttagagaaatgttagcctctcttgtgtgattctaagtcratgctgccctgcagggtctttatgagtgttccgctgctgtctcwcctacaaacrtgtctgtaagcaccttcagggaggggactctgtggcctggggaaggccgactaggtgaggcagagaattaaaacacaggaacacacaactgctgggacagaggccatctggcaggcacccrtcrttcctgtgaggagaactcaaatctcagaagctcatgcatttcgtagcagagtcaggagctacacatgaaaaacacacctgtgctccctcaactggggatcgtctcactaggctgcacctcctgagagctaaagtgcgtctcaaaagccccactgttccccctgtgttcctataataggagcaaagagaggctgatgtctctttggaggtgcaaactcattttgacaaagaatagsaaggcagttaaacagggaaatatcgtactttttttttttttttttgaggtggagtcttgctctgttgcccaggctggagtgcagtggcacaatcatggctcgctgcaacctccgcctcccaggttcaggcaattctcctgcctcagcctcccragtagctgggactacaggcgcgtgccaccatgcccggctaatttatgtatttttagtagagacagggtttcaccatgttggccaggatggtctcgatctcttaacctcatgatccgcccrccttggcctcccaaagtgctgggattacaggygtgagccactgcgcccagccggaaacatcatactttctatggcacactagacactcagtaaatccagatgggattgcaatgcatggaagcagctccctggagaaagtcggatttccctggaaaccacactggtattggccccaggaggtcactgactgctggggcagcactcacccagttgcacatcatggtggcagagccccgcctgtccagacctgacttcccagcttctgaggctgaaggagaacagatgaggcttgctctggcgtcgttcggtgaaaccactgttcctctctcgctgctttcccrggtttccttrtgcattttgagctgtgcatctgattctttgggtcaaagcaaggactgaaaaagagcagaacacaagaagagatcacartgaggcaaggtcccggggctgagagagaaaggggccacccttgctggtgtttctccaccacagtctctttaaaaattgggcatgggccgggcatggtggctcatgcctataatcccaggactttgggaggcggaggtaggcggatcacctgaggtcaggagttcgagaccagcctggccaacatggtgaaaccccgtctctactaaaaatacaaaaattagctggatgtggtggcacacacctgtaatcccagctccccaggaggctaaagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggtaaaatcctgaaagaccagattcagaacattgctctcagctcactaactaggagactttaagtaagacctttggcctttctaagcccaatcatcaccccctataggagagggataactgtgcctagctcaggggggttcttatcaataaaagacataacgtctgcaaaactcctaacacatatcagtattcctgaggcgaacactctgctgcacgtgtgagtttgcgttttacttcttcctcctaaggtaaaactgaaattttttaccaacatcgccaagctttgaagccttaatttgcaccacagctgtctcctgtccttccaaattttctttttgtttgtcctgccaaaacgaagttgtttacaaagatatgtggttcagagacgtttctggttgctttgacgccgccttgtgggcaagtctcggaaattgcatgtgtccctggcccagcaaattgagcaaagattktattaggtgcatcttatatttccttatcattctccctgggtctaccttcagatgattccttaaggcaaagcctattttttctaaattataaagtaaactttagcatgtaaatatcgaggtaagagtagtgggtagcatttttatattggaaatcagtaacattgcaaaattctgtttgcaacwttattttcagaaacggggacaagtgcatcatcaaagcagatatttatcataacatttatagttgtcccataagacaaatcatcttgactttgctacttttcactggatctcacaagaagcttataagaagcgggccagatatgattcccgtttttcacaaacragaagggtgaaagggtcctcccaaaactacacaataagggattaagccagaagtagagcctgtgacgttttacatggccagaaaaactcttgtgctgctgttgatatygttcttctgtttgtttagcaagtctgccttagagaracttcacagcacccctgggcctcacttagcactgatctgtctcccaggagtgggccccggggtggtggagggtcagggatggggttgccgtgcacatcagtctgctccatctaaaaaagctcaccgacatcaaaacatstggctttcctagaaaatactggaatgtctggaatttttttttttttttttttttttttttttttgacagagtcttgctctgtcacctaggctggagtgcagaggcgcgatcttggctcactacagcctccacctcccrggttcaagcgattctcctgcctcagcctcccgagtagctgggattacaggcgtgcgccaccacacccagctaatttctgtgtttttagtagagacggggtttcgccatgttggccaggctggtctcaaactcctgacctcgggtgatccacccgcctcagcctcccaaagggctgggagaatggctggaattgtggtgtcattttcttttcaaggccatcagtgctgcaattctgccattcattccaaaggcccattagagaaggaagagaaaaattccatgtcatacgagtagcgccaacaaaaaaataccttctgcgtgcgtgtgtgtgtgtgtgtatttatgtgtgtctgttcacagatgcacccagctaagcccaaacacattacaaggtagwacagatgttcatccccaagagagtctgactgtcttgcttttaagtttagtgcctcaatcctattattccttctccattttgttttggctaataaagcaacttgcccgcaactcatccttggagcagcagtcatgaattaacgaagattttttttccctcttttccattaaaaaaaattttatgtgccactaytatgtcctagggttttgtttttaattgtgggaaaatacacgtaacatgaaatttaccatctgaactatttttgtgtacagttcagtaatgttaaaaatagtgccaggtgcggttaatcccagcactttggaggccgaggtgggtggatcacttgaggtcaggagatcaagaccagcctgatcaacatgtgaaaccctgtctctaccaaaaatacaaaaattatcygggcatggtggtatgcacctgtaatcccagctactcgggaggctgaggcaggagaattacttgaacccaggaggcagaggttgcagtgagccgagattgtgccactgcactccagcctgggtgacagagcgagactccatttcaaaaataaatagataaataaaataaagtgtattgtatagttgtgcaatcaatctccagaaggttttcatcttgaaaaaccaaaactctgtccccattaaataccagctccctattccccctccccacagctcctggcagccactattccacttcctktctctagaatttaactattaggytggtgcagaagtagttacggtttttgtcactgaaagtaagggcaaaaacttctgttaatacttaaggtaccttatgtaagtggaatcattcagtatttgtctttccctgcctggcttacttcacttagcataatgttatcaaggttcaytcacgtagcatgtgacaggtttcccttcaccttgaaggctgaataatattcctctgtgtggakgtaccacattttcttcaacgccttccctatccctcctccctaccctctgcccagaccctggcgactgccactctcagcttctatgagttcaacgtgtttacgtttcacatataaatgagatcttgcagcatttgtttttctgtgcctggcttgcttcactcaacatcatgttttccaggttcatccatgttgttgcaagtagagattttctcctttttcagggctgatactcccctgtgtatatatagcacagtttctgtatccatttatccactgatggacacttrgagtccatatcttggctattgtgaatgaagctgcaatgagcaagcaagtgcagctgtctcctctacatactggttttatttccgttggtaatttacccaccggcacattttccttatttctttcatccatggatgggtcctaccatgtaccatctcagagaagcttaggcacagtttgttgggatgtcagacgctgagcagaatggcgcgtgccctctaccttccaatgtccaaaaaggaattcattgaaagatcaacatacaaagccttttttgccagaagagtgggttggtgaaaggataggaatctttcaaaatgttaggtaggcttccagactttaaatcctcctccctaacagatagactcagaccccgctatcgagctgtaggtagctcttagagatctttcatttctagatttgagtgctttggggktttttttgtttttgagwtggagtttctctcttgttgcccaagctggagtgcattggcatgatcttggctcactgcaaccactgcctcccaggttcaagcgattctcctgcctcagcttccrgagtagctaggattacaagcacccaccaccacacctggttaatttttgtagttttagtagagatagggtttcaccacgttggccaggctggtctcaaactcccgacctcaggtgatccactagcctcggcctcccaaagtgctggaattacaggagtgagccactgcacccrgcctagatttgagcactttgctatcctaggttctctttcctggcacaggacacaatttgattctgcatgtcagtgattagagttgtgccccctgaactgaacagccatagatagcaaggctttaaggaagggaactgtccagatgacctctttggatgcctgattactacagagtttatgcaaagactcaggacagtacaagtcagcaaagcacgtaggcttggtttccaggctcacaccagagccactgaagaacttagacacataccagctttcttaggtccaatatctgccacctaagttcccatgtcactgatgggaaaataaaaactaatggcatagtttcattgtttctttataagcagaggaaaagtacaaattgaaactgaaaagtgtttactcagactcaaactcaaaaatttcagcattgtttagacactgctctccagtcattggcttcccaagagatgggtttcagggtgatctttcttgcacaccatcatcctcgaccatttactgagtggccttgagacgctcaggaagagttgtcactcctcagcctcattcctgttaatttcctgtctgccttttggttgtgcagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacccacggtggctggagaaggaagcaaaggaccttctggtgaaggtaagaagcgaagccaagagcgtcttcataagacgagcattaggtcttctggtcagttttctgttcctcttagtttccaacttgcatgtggcaaacaatgattattattgaactgggtttaaatgggatgtgcaccgtctgtgttttaatagaggcaccaatattatgagcattaaatgtcaaaatgagtgtaagagaaaccctcatgtgcatcagttataacataacggcccaggaaccagttccatgaccttgaatacgctcacctggagatgtagttggttcattaaacaagcacagtgtgtggcttaaaaatcaatcttctagctacttgggaggttgaggcaggaggattgaagttggaagtgtgaggtcagcctgggcaatgtatcgagacccctgtctccaaaacaataaagggaaaaaaaaaagaaacaaaatgggcatttaggctgggygcagtagctcacacctgtaatcccagcactttgggaggccaaggtgagcggatcacctgaggtcaggagtttgagaccagcctgaccaacatggagaaacacggtctctactgaaaatacaaaattagccaggcatagtggcacacrcctgtgatcccagctactcagaakgctgaggcaggagaaaatgggcatttatgttatatagagggtttttttttattttactcagtcttttgtttcccatagttttttattagaaatattcagtccagttcatcttcccctgcctctggttgaaatcttggacaggatgtatgactttttggcctgctcttagataaaagacaacctattgtcactcttatgttatgaaacactgtctcagtggggaaattaaaaccatccagtctgggatattattcatcacataacttttttcttttttgagacagtctcactccctcacccaggctgcagtgcagtggcatgatcttggctcactgcaacctccacctcccaggttaaagcgattctcctgcctcagcctcctgagtagctgggatcacaggtgcaygaccacactcasctaaatttttgtatttttagtagaggtggagtttcaccatgttggccaagctggtcttgaactcctgacctcaagggatctgcccgcctcggcctcccaaagtgctgggactacagatgtgagccaccatgcccagcctcatcacataaattttaattttaaagctgggactcctgcttcctttcctctgctcagagctcgtgattggcagctgctcactactggaggagacagtgttgtcatgctcttgctggctgtgttcttgttctcttccattctaactcctgagtttctgcttcagaccttaccaggtagaagctgagagaggaaagaggatgagcagaaaaaaacagttcttattcggctggcagcctcctacccctgaactggaggatggctaaagctgagacttcaatgaggcactctactaggttctgcagaaatacttatccttgcagatgtgtttggctgaaacccttgagatacaggcattcagtccagtccctggcctatatactgtaccaacgstgattctgcaagactctctcactgttggtttcctgcccagcagattgtcytgggcagtgtactagtctgttctcatgctgctgtaaggacatacctaatactgggtaatttataaaggaaagaggtttaactgactcacagttctgcatggctggggaggcctcaggaaacttgcaatcatggcagaaggcacctcttcacagggcagcaggagagagaatgagagccaagcgggaagggggaagccccttatgaaactatactctcactatcataagaacagcatggggggaaaccgcccccatgattcaatcacctcccatcragtccctcccgtgacacatggggattataggattataattcaagatgagattctgggtggggacacaaagccaaaccatatcagccagtacagttgacctttgaacagctcagcagttagaggagccaacctcctatgcaatgacaaatctgcatatagcttttgagtcccccaaaacgaccaccaataacctactgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagagggctgaggaagagggggagttggtcttgctgtcttaggagtggcagaggcaaaagaggtggaggaggtggaagggaggcaggagaggcaggcacacttggtgtaaatttgattgaaaaaatctacatattagtggactggtgcagttcaaatcyaggttcatcaagggtcaattgcacttaaaatacctacagaccagctctccccaacctgccctacccactgtccaccagaaatattgttgacttcttcactctaacaaactctgagagtacaggctattaccatcttagcagcaatctccagaattcaccatcaaaacggaattcagygccctatccgtggtagcccaggatccatcgagaatacaggcacagtattacaggtggaaactgggctctgagaatcacaaggtgtgagccaggagctcccaaggcaaacccacgtggagacagaggaacacctgagagccatcaagaaagatctggactctagacagactcagagttggccttttttgaggatgcgaaatattctccacagtgtatgggcgtagcaagttgtagaatgaaatgaatcatgtcaatacaacatgctaaatacatagaagaataataaggacctacatatactgagctgtcccagcaaatatttgggtcaaagagacccatcactgtaatcaagagcctagcacatctaggctgggtgtggtggctcatgcctggaaccctcgccctttgaaaggctaaggtgggaggattgcttgagcagcccgaaattcaagaccagcctgggcaacatagcaagaccccatctctacaaaaaatctaaaaattagccaggtagggtggctggcgcctatggtctcagctactcaggaggctgagatgggaggatcacttgagcccacaaggtggaggttacaatgagccatgatcacaccactgcactccagcctaggtgacagagcaagaccctgtcccccccgcaaaaaaaaaagagtctagcacatctaaaggaagtggaccaagaatgcaggtgttttggaagaaacattgttttgatttctggcatttcatatgtcagctggttaaaaaataatcatcatttagagaaataatttttagccttgttcgtgctatattgaaaatgggaataggataagatccttcaacattggaagctatccatgggttctaaattaaaaactagaaaaatattagcaggctcatcttttttcactaatctacttttttgcttttgaagaagtacttagaattaaatgtaaagggaatacacttccacctctctaataaaagtgacaacttgtcttgggcattagaaacttggaggcaactccagggctctccctggaaaatcaagatcttgaatmtgagaagtgctgacaaagccctcacaggatccccagcccaggggtaaaggaacaagatgtttaaaaatttgagccacttccattcagctttcactttctgactatgatccaaacaagcaatarcttagaaaactccctcaacaatcaattaaaggcacttttaatgaccaaacacagataaaatgaaaactaatctcaaaattaaccaatttttttaaaaaggctgacaacagtaaaaataagttagtgggagccgggcacggtggctcacgcctgtaatcccagcactttgggaggccgagatgggcgrgtcatgaggtcaggagatccagaccatcctggcttacacggtgaaaccccatctctactaaaaatacaaaaaaaattagccaggtgttgtggcgggcrcctgtggtcccagctacttgggaggctgaggcaggaaaatggtgtgaacccgggaggcggagcttgtagtgaaccragatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtagcaataaatgtagcaatsgtaataatgaactcagtgtgaaatgtgtcagcttgggctccataacaagatatcacagactgagtgggttaaacaacagacatttctttctcacagttttagaggcagaaagtccaagattaaggtccagcartgtcagttcctgatgaggactctcttcctggctkgtagacagctgccttcttgttgtgtccttacagcagagagagagagagataaactctggtctctctttcatgtgagacttctagccctattggatcaagaccttaccccatgacctcatttaacccgaattatctccataaagcccttayctacagttacattgtgggttagggcatcaacatrtgtattttgagaggacgccattcagtccaaagcatgaggctgcactgcaaagcctgggccagcaaaacccactggaaaaaagtgagcacaaggcttagtctgtacaacctgaggcgtgagagcacctccagactcaggggctgtctccaagtgagtcccaaggtggaggctctggagggagagtcacaatcccccaacacccctcatggcccataaatgccagcttccccctgtgcttcacaaacccagcctaccttgaggatatgcaatacttcaggccaggacggagagtgaaggagggacagaggtaaccagaagtaattccgtggagagaagttggaagtgatgatttccaaggagagaaagattggatgggaagaaagggttccttccagttggaggagaaaaggtgaaaagccgtgtgctggaatcctactcagcaatgaaaaggaacaaactattgatctataaaacaacccaaggcattatgctgagtgcaaaaagccaatctcaaaagatcacatactctctgagtccattgatataacttcattaaagtggcaacaccatagaaatggaagtcagattagtggttgcctggggttggggtgctggggacaggagggtgggcgtgactctcaggatgcagcacaggtagatctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaacatcctgtgaatctataattatttaaaaacaaaactaaatctaaggctaaatgccttgcaaacacccaaataaaaagtcatctgcagagtttcagtggcaagagaaagagttgccacaagagaagaaaataaatttggttgaatagagcagaaactaagataataaagtttaaagaagcaaacaagaggactggtgggtgaaagaggttcttttcttttttaagacagagtgtcgctctgtcacccaggctggagtgcagtggtgcagtctcagctcactgcagcctatgcttcccaggctcaagcaattctccagcctcagtcttccatgaagctgggactacaggtgcatgccaccaatgcccagctgatttttgtattttttgtagagacrggttttgccatgttccccaggcaggtctcaaattctggagctcaaagcaatctgcccgcctcagcctcccaatgtgctgggattacaggcatgagccaccattctcagtaaaaagaagttctaaatgaagcttgcccaacccacgccctgcatacagcccaggatggctttgaatgcagcccaacacaaattcctaaactttatgacattacgacattttttgtgatttttgttttagttcatcagctattgttagtgttagtgtattttaggtgtggcccaagacaatccttcttccaatgcggcccaaggaagccaaaagattggacactgctgttcaaagttgacatagaagagtttggacttgttatttcccatgtgagttagtaaaacttccatgaactttctcttacacatattcttgcagttgggctgataaaattaatttccattatgcaatctgctgcccataaactggcttgcagctttatctctattcctcctttgctttgatccaacagcccccacattcttgagccccatttgttgcaaaaataaaaggtaatgccctttctcagaaacgtcttctagggaatttgacaaaatgttatgaaacccagaagtcataggtcctcyggaaaagctgaggatagcagcatttcatggcatctgtgacagcagcagtgccagacccgttgccattggcccacctagggcatggatgcatgtcgtgcactgaacaattgcccactgggagaggctgtgctctggcaagaattccagtggggacactgctgtccagttgatgattgccaaagaaacaccctttactccccgtctctactaaaagtacaaaaaattagccaggtgtggtggtgggcgcctgtagtcccagctactcgggaggctgaggcaagagaatggcatgaacgcgggaggcggagcttgcagtgagccragatcgcgccactgcactccagcstgggtgacagagcaagactccatctcaaaaaaaagaaaaaaaacactctttacttcctcatttatccatccaggatgtcctgtctatttgtttgaaaatgatgggaaactaatgatatagaacataaatatctcttcctttcatagaaagacatatctgaggagggactgaagagggaaggcaggytccaggtacaatctgtcagcactactgctggctgtcctctgcagcctggagctgctttcttgcacagactgtccaataaacttaaacaaacttcaactacatcctggctattttttcccatcaatgtaaacctccgtcctgacagcttttacagacaaaatcaagtcttcaggtattttatttcctcagtgcagctttccaggggcggagcttccagcctggccccactcccatgaggtcacctgtcatcctcaggacctcagtgggttgagtcgctgcaaggcagaacatatactaatttaccgttctgtgcaaaactggaaagaatattgacgctcagagctggagaccatatgctcttctcattacacatttwattttttaaaatatatttttaaattttgcaggtacacatccaagctaagaaagcccattgacatgatcctcttggtacaaataccacatgttcactggaagaaatagaatagaaaacccagcctgcagcacacacggcccagggcagttacttccagcctactttgctgaagcatctcattagaacaacatgagcgaggttttggccccttcctgagacacttacgccatctatctaatctcgtttcatccaaatgtccttaagaagcagagaccaatcatttatcatttagtatcattgtttcaggagaagggatatagggcaagtcacttattccttttgcttccttttttttttttttttttttaaggagtcttgctctgttgcccaggctggagtgcagtggtggtgcratctcggctcactgcaacctccacctcccaggttcaaatgattctcctgcctcagcctcccgcatagctggggttacaggygtccaccaccacacccggctratttttgtatttttagtagagatggggtttcactatgttggctaggctggtctcaaactcctgacctcaggtgatccacccacctcagcctcccaaagtgacgggattacaggcatgagccaccgtgcccagcccctctttgcttckaaaacatcaatcagctccatgtgatgactcctgctgttttatggtttgtataaatgtatggggtgcaggtgtcatttcgttacctatgtggattgcacagtggtgatgaagggcttttagtacccactccattttctgagtctacagaaaaatatatcttaccgtgaacttggtgcttcttttctatgctgaaaacaggcaaccgagataaaatgaggatagaagatgcgtgatctgcagataaacaaaatggaaagacagcttattcacttactctgcaggcatctactgagcatctatgttgtgcacggcactatgctagcttctgtaaggaatagatatgtcaatggtgcccggcctccagagcttacagtgtggtaggaaagaagacaaccttggaaraaagatacaatgtgctaattctccagtggagcgaagatgttgtrtggtacacagatgagagattatccatcaggatgagggggaaggaggccrcttgtcatcaaagtgctagatcctctgaagctcggcttcctcagcygacaactgggatgatgaatttgtttctcttagaatttgtttgaaaatcactgaggcatctagcacagtgcctgcctctcaaagaacattggttggagtggatgwtgtatcagtcgtaagaatcatgagtgatgtgaatgatgtatgatagggtgatcaatcctgaatatgacttgaacagaagagagagagctccctgtcaggggaggtaatcaaagaaagtttcacaaggaaaagggggtgaaagctgagccctgaaagataaggcagaatttaaagatgaggggagggaagcaggagtcgactaggggagggtrtctcatggcaagatggaaatgtcattagtgagggacagagacaggaaggcaggtggtgttttcggtgagcagaaatgtctggactggagagggtcctaatgggaaatggwaggtcctgtgagtcagcgtcagactccagagagccttgaatgccagcygaggrcccgaggatgtcagaactctccaagccctagagatcaccttgtctagcccttcctttacacacgaggaaactgagactcagaaaacttatccaaggcgacgtgggtagtcagtctctcggatagctgtcgtgttatttccaccgygcagtggctttctaattgggtactttggaaccccaagtttccctagagagtcctcagcagtccccatatggtaagggggagagaggaagttgagactgctaagaatttgccaatcagatacaccgggtgattgcacaaacatttcaccyggaactttaaaagattctcctactttttttwaaaaaagcgaaaaaacttcactttacaatagcatgttgtttggtytttatatttttttggtagaacggagcctttgaagattttcaagtactcagataacacaagtgaagcactatttcagaacatgcaggctggctatgtttatgagcagtaaaaacaagagactcgcaatttaggtgtgaatggaggtcaagtccctgggaaagcctcctggaaaatcacgcgttccaccatgttttctgttttaaagaaccttaggctccttaaaatgccctataactcatggttacttcataaataaacatctagctgatgtaagaataacyggtaactactccagacacccaggggacctgttacttttctaagttaatgtttagactctcctgtttcttaatgcccttgacaggttttatttaagtttgaaaaatatccaagtttctttcctgtcttgccagtgttcattttaacttcttaggcagaaagaacaggagaaggaacagtgcagagaggaatgtacatatgtatgtatgtgccagctcagaaattattagatggaccttgaattaaatattgctcctccagcaggtttgcaggagctgagggtaattctcttcactcagatgccttgtagagtccaaagctgactgtctgggactagtttctattatacctgagtccccacaatgctggaatcattctaagaatgcagctttgtaagaaatcagactggagtgatggataattgatcaaatgacaaattatcactgactctatgctgttgggtgtaacagaccaggagttatactgcacaaatgcgtgcgtgtgtgtgcatgtgttcctgtacgtgtgtgtatgcgtgtgtatgcctgtccgtgtgcgtgtgctcacatttgtgttttagtgggtgtgcaggtgtatgtgttcatgtccatgtgcatgtgtatgcatgtgttcatgtgtatgtatgtctgcacgtgctcacatttatgtgcatgtgtgccagtgtgtgtttatgtccatgtgtgtatgccgtcacatgtgcctgtctgtgtgcacgtgtgtgcctgtctatgtgygtgtttgtgtgtgtattgctgtcttataaatcgtcacatcagccctgttaggagggcmcttggcttactttacaggtgaggaaactgactcaggtttgtcagttgcctaaggtccaattaataacacagggcaaagccggtttcaaatcaggtctatgcacctcagaagataacgygtcagactccagcaaatttagaaaggcttcttcaagggagagtgccaggacaggttgactttagtcagtcctgatgaaggtgagtagaaaaatgaggttagaaaagaaggggctggtgcaccaggaagcaccacgmcctcctgatgcaaaagggtcatccctggagacctcagggctcctgctctgctccctttcagctcttcgtgmgagaacctgagaagaggctgggcgtgaggggagacatccgccagcaccctttgtttcgggagatcaactgggaggaacttgaacggaaggagattgacccaccgttccggccgaaagtggtaaggactcgctcatgggccgcttggtgtcagccactctccctccgctcagggccgtctgcctgtccaagtcaccgcagctgctcacccctgccggtgccccaactccccaccagccccactctccaggaggaatgcacgtctctaacacatgttactgggctggtggggcagggaggggaggtcactcttgtttgcaaaatttaatctctgtcgtcaagatgcgcctgcatgaagaatggattgctgtgtgtccacgccttaggttgaatatgaatttgtgagggtgactattaaacaagatgggggttgtgcacatgacacatacgtacttaatggtccagtctgggtaacccaaacttggacataaaccctgcatcctacgtcaggaattttggagctgttttttccatgatgtttattaaagtatctgtaaagtgctcatataacgacatttcctaagggtaattgttaggtgttctttggtttaagggagaaactaactaaatccgtgctttaaaaaakataggtctgtacatttccatttatgtcctcactggcaaaagtcattaagctacatcagcaaaggcagaatgacctggctcacctgcgagacgggccaccataaagtgaagtcaaaaataaagcaaggttgggctgggcatggtggctcacgcctgtaatcccagcactttggaaagccgaggcgggtggatcacctgaggtcaggagttcgagrtcagcctggccaacatggtgaaaccttgtctctactaaaaatacaaaaattagctgggcatggttgcgggcrcctataatcctggctactckggaggctgaggtgggaggattgcctgagcccagaagtttgagactagcctaggcaacatagtgaaaccccatctctacaaaattaagtgggcttggtggtgcatgcctgtagttcaaactcctcrgtaggccaagacaggaggattacttgagcccaagaggatgcagtgagctgggttcacaccactgcactccagcctggtgacagagcgagagactgtctccaaaaataaaactttttagaaaaacaacaaaaaaaagtcattaagaaagtaaattttaagttatgtatatcacaatttctaaaaataatgatttttaaaagagtagagcaaagttgtgggtttgccagccttaaccattccctgtgattgcctggatagacatgggccatatccgygctgaagggggccaggctcatggacttcccaacagattccaccccagagaacgcacaggctattagtcatgatagcgaatggccagaagaagcaggtgcatctcattcccagggcaagaatagttgttctcaacatctgtcccaagctccagtgatgttccaaggacccaacaggccagcctcaagcactctaattayttgtgacagaaccacatctaatacrtgggttagtcatttgtgataaaataaaaattttaccttgtttttagctatcagaactattaaaccatgtctcaccttccactgcagattaaaattgacttaatattttgcacataaaaatcaaaactttgatctaagcttaccctaaaggacattcccagttctgccagtaggaaactttccctgacctgtggtctgagctgccattgacctcacagccccagggccccttggagggtgggaggggcctggttcttcatttcgcttctctgtgttcatagcactttctgttgataatggttgttctcaatcttgggacactgaattgaacaccatactgaacagcatgtatgaaatagatgtttgctttccctttctctgttgtttggtttggttttggtttttttgccatgaaaaccaatggaccaagtggtctgaaaggagtctgtcccagtctgtgctgtctaaaaaagcccaagatacttactaataaaattaacaagggcaggggactgacaacagccaagaacgttgataaaagaacaggaatatgtaattgtgaaattccttctctcttcccatccctccgctcacaccccctcactccctctccccaccaccctcccttatccccaccttgtgttccatgaaaactgaagaggcagaggtcaaattcaggtggatcactttttcaaaggttgccaaccctgcttcatgtaaaccattagaaayattagatcycatttgaatgtctacagtcgtagtctttctgtgaatttatgaatttatattattattaagctgaggacacaggatcacagccatgttcaatgagagctgggcatggtcatctgtaggcattgcctccatttagtgtctctgcaaacaccaactttgccatacgcagatcacggcctagataacaaaagtgaagatcatgaacttaatggctratttttcttctctttctttcttcccttaaactctgactaagaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaakactgagacccgttcgcccccrtgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccrttgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttmatggcaaacaggtggatgtgtaaaaatggaataaaaaaaaaaaaagagtcctcttaatcgtttacttccccgcttgccccccacaagaacttgcttctgctgtgtcagtcctcaaaatgtagctagcattgagatgatgttttacagttgggggattggctgggcacgatggctcacgcctgtaatcccagcactttgggaggccaatgtgggcagatcacctaaggtcaggagttcgagaccagcctggccaatatggtgaaaccctgtctctactaaaaatacaaaaattagccaggcgtggtggcgggrgcctataatcccagctacctgggaggctgaggcaggagtagagtaagacaaagggtgaggaagtcagatgacattaaggcaattgtaagaaaagcaagtctgcataatattyggagtcactagcctacctcawcacatggctggaaataactttagatattatatttaaaatagaataattaatataagcagactgttgacagtctgcaggtrtgctggarcattttcctgactatayggagctcttgtgattttttttaaatagacactcccctaaaatgaacacgagtaacctcatttaaggatgggcatctatcttcagatgtgtccattcaggtgtccgggccctttgttctgaaaatagcaccatgactacaaacctctagttatgtgagaaggcgacacttgtcctccccttgctccaaatgaaaatgctcacacatgtttaccaaattcacctgcttgaaggagggagagggtcctttaaggccctggatgggccagtggagggcagggagccgcccgttctgttctgatctctgctctgctttgcatttgctgtgaagccctgaacaagtcatttcatcttttggggcctccaagtaatggaggtgaagatgctgtctaaagtcccgtctcactagagtgatggggtcggtgaagacgctatctaaagtcccttctcactagagcaatggggttggtgaagacgctatctaaagtcctcactagagcgctttctggttctaaatctgaatcaaaatcctgcaaagttaaaaggtcagtgagcaacactttccaaaacacagacactcgtggattccactcgctgcaggcctgggggcagctctaccccattttccttccmgtcgtcctctcctcactctgggttcccacatacccctgccccagcacccagcatcctcctgacacccagagaccccaacaggacccctaccaggagacaaataagtgaagactgttggctcttagaaacaggaaccaacgcaacttttatcccctccactagaccaaaataaggtctattcatcatttggttttgtttgttttattttttatttttttgaattagagacagagtctccctatgtttcctaggctggtcttgaactcctggactcaaatgatccccctgcctcactctaccaaagtgctgggattacaggcctcatcatttgtttttaataaatgtcatctgtatgaatatgtcaggtgactaacaagcttactatttgcttcgtatttctgagtgtgcgaagtacttgttacttccttctattctttcaggtgtcctctgaaattgcttattaatatccctatttaataggtgagagacctggccaggtgcggtggttcacgcctgtaatcccagcactttgggagacccaggcaggcagatcatgaggtcaggagtttgagaccagcctgaccaacatggtgaaaccccgtctactaaaaatacaaaaaattagctgagcatggtggcacgcgtctgtaatcccagctactcaggaggctgaggcaggagaatcgcttgaactcgggaggcggaggtcgcagtgagctgagatcgcgctactgcactccagcctgggcgacagagcaagactctgtttcaaaaaaaaaaaaaaaaatagaggagagacctgaggcccagggagaccataaagcttacactagagggttgaccagtggagacttgaacccagaactcttagcatcagatcttgcttcattccagagtgcagggtttcagcgacatccaccaatcagcatctgatgattgttcactaaagttttaagtggacttcctaattcagggccacacctggcttacctgtcccccttctaggggaygcagtgcgggggccagtctcttcgatgccggtcctctcatcaccactcccagttcccctccactttgcactttagcctagactcaaccttgccaatagaaatgagaactttacctcaggktatagttaaaggttttggaaaaagagagatcagtgcttctttttggaagatacagactgagagtttggctgagagctccctgtgcacgagaggctggccacagagagagcattgaccaggattttctcagatcccgtccagcaagaccatgcttaggagagaggaagaagtcgtaaatcagccagagaagaagaaatgcctttgttacatcataaaactgcaggcaggggtctgagctctcagagcctctgtctccaatggacccatcaatgatggccaacagaggaagcatcagccttaaacacccacagaccgggaacatcccagaacccactcacaacaatgcaaaccaaggaagacttctcctgccacctctctcctttctctgtcctttcccaacttcgggraagaaggagcagaaaccatggtcatcggactgcggaaggagaggactgagcatgggcgggtgagaagtatgaagacgctgaccacgtgccttccccaccacaagccaccagcactgccctctcgagctagatgagaggacagggtcaactttaaatcrgttttcaattattcatggcattgcacatgtaagttacagaaatgaatcttgagggagcaactgaaggacatgtctaatgtcaccggaaaggtcatgggacctctgagatttcagccaaagtttggaagaatgagccccacagagcaggtctgaatggatggtgggcgcaaataataaaggtgttggtttggtttggttttgccccgagaattttgcttgtttacacacagacaagccctagagtgacagtgatgttgctcttggtgccacagctacacaggagatttcttgcacgtagggaccacgctctttaccaccgagcctaccaccctggcagacactcctccatcacgtgcatttgttgagtgagtgggtgaataggatgtgggtgagcacgtctctacaatcctctgtctgtgtggggcctggcacacgagaatgcctggtggaaattacttcgtcctacaggcactacaggattaactggacttaggtatcaggtcctctctcctgaagaattttagacagaggcaaaaaccagatggccaagagaagaggcatttggtaaagaccacaaggcagccaaagggatgggcagcagaagccaggaggtagggtcrgtcacagtagcagagacacagggtcgtcctgccaccgcagtgtgggtgactcaaggagggctaagactagcaacttccagtaagttgctctcacttcccggagttactgaggggtccccaaggtgctgggagtcttgcaggcagccctccagtcagtcctgtgttattcctctctctgactcagggaaccatcctgatgggcagcagcccccagccgacrgcaggccggggaatgaagccactggctgctctccttccctcaatgccgtctgctcagtctccyggagggtcagtgatgagggaaggagccccaacttccttgtttctccctgcgtcctaaataagtccggaacccaaagagactgagtgtgtccctggggcatgcgygtgcctgtgtgtgtatatcagagcaagacaccacactgccgtgagcaccaggctggctgactcattgttccctacatgcctgatgtctgctcctgctctagggcttttrctcattctctcctaccagsctgaaagggccaacacatctcataaacaaccccaaagccaacccaccccaggcctggctgcagcatcagcctcctgcctttgctgaccacaccagctgttgctgtccagagatgcctcccacctctatttgtcctctgaaataagcatagtgaagagctgggccaaactcccagagcccagagatatttggaaatggagtaggcgccacccaagtttgtttctgtacagcacccaactcactgtctgagaaggaccctcagaggttggcagcaactcccaccagggggtcatctgagaggcacagtgaccacagtgatcaatgatgtctcaccatgaggacaggaaggaaatgcccagccagggaacatgttttctgcccccagcttctgccttccatgtcgtttcttcactctactgcggatgaagctttgactataaaatatgctgttggaatgcaccaactgccctactcccaggtggcagaaggagagctcagttttccttctggaaaattcttgcaattaccaggtactgggtgaagtgctttgtgtatattacctcatttaacccctgacgacaatctctgaggacagcatcattgtctccattttatcaacaaggacactgaggtttggaaagattacacatctttcccagaatcatagaagaagagctggaactagatcccaagcctgtttgatgacaaagcttgtccctctatcaccataaggggagggacagcaagtgggttatggagtcaggatgcccgggtcacacccagcctcacccccgatgtggtgtataaccttggacaagtcacttaaacactcagcctcagtctcctcctttytaaaatgaggaccaaaaaataaagacaaaaaataaaataaaataaggacaataatagtgctagcctcacaagccatatgagaagtgaataacgccatctatgcaaagcacttggaagagtacctaatgtggaataggyamccactaacatagtattattattttattgctgcatcccaacataaatcatttagagacctctttcataggaaaaataattctatctgattgatcacaaagaaagggggtatcaaacctaaatatgaagaagtaaaaaataaaaacttctgctttatttttcttatacagctataaaagcaagatacaatttgtaaaagttaatacaaagaaaactacaaaagtaataacactgacagaacaagactgattttatggtgatgatgacattacgaggctaaaactaaacgactaccctccatgtcaatgtgtcttaactaccatggtgtggtttcttctgagttcagcacggttagatgagcacacatggtgcagtgactcsatctatgcaccacctttctctactggaactatcaaggaagagccagctgtgcagtgtgtcttgatgtcattcaaccttcatttgtcaaaaatgcttaagtgcatctaggctttttcttatagcacatgacaaattaataccattggtggaaatgaagtcatgaacaaaatgcaccacaaactctgaattctgacaccgtctaacagaactttctgctgtgatggaaatgtaccacatctgcactgcacagtatggtagccactagccacatggagctattgttggcttgaaatgtagctgagatgaagaaactgaatttttctttctttgagacaggcctcactgtgtcacccaggatggagtgtattggcacaaatacagctcactgcagcctccacgtcctgggctcaggtgatcctccaatctcagcctcccaagtagctgggaccacagatgtgcaccaccatgcctgattaattttttgagtttttgtagagacagggtctcactttgttacccaggctggtctcaaattcttgggctcaagggatccttcccccttagccttccaaagtgctgggattacaggcatgagctaccatgcccaggctacaacaattattatcttcagaaacactaaggatgtattacat

SEQ ID NO: 13305 - DNA, 50353 bp, Homo sapiens
gagcagagttagtggtttactgtttttccactaagtaagtgtataggataaatattatgtgcctactgtgtgccaggcactcttctaagtgtttattgttcatttattttctcgaatcttcacaagaatgctctaagtcagcaaatggaagtactaagmaatcaggtagtgtgtctaaagtctcacagctaagtgaatggcagacccaggactgaaactgatcattcagatgcttcttttctgtgtcctagtatttctaaaaagatatttgtagaaaacacggcacttgtctctaagagatattaacactggtccttcctgctccattgaaattatggatatttccatagactccctggtcacccacaatgattttggggatggtagatatttttctataccttgcatataaattaaacttaacaaggagccattgccaacgstaatatctcaagaatctgtggtggattttaaacgcgtcagctctscctgtgaaattctgcgcacacaatcaaggacagatggggttgagagctgaattgcaagtgaaagctggaatgtccttattcccattctgaagcaccagggctctgggaggtgcatgtctccttcaaagcttccaataccttgccagtcttatgtgatgctcagagaggcgagaatgactcctcctcatcattaccaacaacaaccatcaatagttattgatcacctctcctgggccagatgcttggtgatgggtggaataccaagacgggtaggataaaacccctgcccttaaagtttaggctctagagacagataaccataatccagggcaatatctcccacgtgtcatagaacttgatatctctgcttctggatctggccagtctacttcttaagcatctcctgcatagctccaagatgaaacaaagggaaggaggcagaagttctggccagtcgatgtaactgtggctgcattttccatgcaaagcaggtttgagtcaaactaggcagttaatccatcctgacaatcggggaaagtggccaggctgacactggatagttaaagagggtttttgaaatggtatgtaatcatctctcagtatctgtggggcattggttccaggacctcctgcagaaaccaaaatccatgaatgctcaagtctctgatataaaatggtgtggtatttgcacataacctatgtgcatcctcttgtatactttaagtcatctctggattactcttaatacctgatacaaggtaaatgctatagaagtagttatcgtactttatttgttttttacttgtgttattttttatggttgcattggtttttttttgtttgtttgttggttggttgattggatttttgttgttgttgttgttttgagacatgggtctcactctgtcacccaggagtgcagtggcgcgatcatggctcactgtagcctcgacctcctgggctcaagcagtcctcctgctttggcctcccaaagcactgggattatagatgtcagccaccacacccagcctgtattgttattttttattgttttattttccaaatatttttgatgttgtgaagggatgccagttttggtggttggttgggggtagggcctgaattttcctaactgaattttcctatcacttatttgttgctgagtttgctaccgctgtccctacaatagaactgttcaatggggttccagctgatgttgattttacttttttagagcctcctattcccttggatctgaaaccagcacttcccttgcatgtttacagacacgcagttccctatctttatggacacatatccactcctacagggtccacagtgccctgtagatcatggccgtaaagtatcagccctgattcctctttggctttgttttcagaagcctgtgacttctgaaccaaagtcagcctccaatctgaggctgggataatgacatatgctgaatggaagaagttggaactgattgttaaaatgtttgaacagcacaggaaacaggaagcaatgagaaacaaaagcaccctccagctctgagtcacagggccgtctcctctgccaggccatgtcagccacagcccagggtacatgtaattgggtwatagatattatttggcccggagaaaaagctgtccgtctgaggatgttgtatgccaaccactttaactagaaagataacagagccactatcaaagagcctcaaacttcaatttcagtctcagagagttctcaacaggatgctctggctagaaattattagttctttgcaagggctcggagtccactagtatagactgagctgttactttttactggcaatgcttcatttttaagttttgttcactattatttaaataataaatcaagaatcttccacaactttgccattgggcctaaccacttacataatcacaatgtacataaagtgttgtttttatgtttttaattgtggcaaaatatacatgacataaaatttaccattttaaccatttttaagtgtatggttcagtcgtgttaactatacccaccttattgtgcaactgaccaatctccagaagttttcatcttgcaaaactgaaactctacacctattaaacaatcacttcccatttccctcttccctcagaccctggaaaccaccatcatattttctatttctatgaaattgactgttatacttacatcatataaatggaattacatagtatttgtcctgtggtgactggcttatttcacttagcataatgtcctcaagattcatccgtgttatagcatgggtcataatttcctttattcatccattgagggacatgtaggttgctttcaccttttagctattgtgcataatgctaccgtgaatttacataaaggtttttttgttggtttttttttgagacagagtctcactctatcgcataggctggagtgcagtggagcgatcttggcttactgcaacgtctgcctccgtgttcaagtgattcttgtgcctcagcccctcaagtagttgggactacaggtgtgcagcaccacgcctggctaacttttgtatttttagtagagacaagattttgtcatgttggccaggcgggtcttgaactcctgacctcaagtaatccacctgcctcagcctcccaaagtggtgggattacaggcatgagccaccacgcccagccccaatttacaaaaagttttatattctacctttttactttctgtcataatatctgtgtgtatatacatataatataaattaaatatattatgtataacatattatagaatataaattacatgttgtatatgtaatctataaatataaattacatgttatatacgtaatctataaatataaattacaggttatatatgtaatctataaatataaattatatatttatttttatatatacagttttttccagtttgatatatagtcttcatcataacctttttttacatctgttttaagggccacatgacagtccttcaagctcatgcacttaaataatttctacagttggacatttgagatgtttgtagtttttctctaaatcctatgacaaaaattttgtacctatgatttccctcccttcccccatattttagcatacctttttagatagattccaaggaagtgaaattactgggtcaaaagcaacatacattttataacttaaaagataaaagatagaaagccgcattgctttctaaaagaatggtatttccctagctactaacagtgtatgtgaatttccattccacagtactcacagtttttttttttattctatgattaaagggaggaagttgastgctcattcatttttaatggacaacaatttgattattaatagtgatgggcatttgtgaggagaccccagacttggccagcctgtgaatactagcatggttacagtaaactgaaaaaatatatctatttgatctaatatgtattatccctataatatatgagtatgtattagaaacatgcccaaatagtacrtaatccataaatgatagctactgttattgttgctgttattcttattattgcccaacatgtgatgattcttagtctatacctgctttcccaggccctcaatttcccaaaatcatgatttcccaatttttggggggcatccccagttaggtgctgtctcggaacattcctgtgaggctgctctacccaagccctctccctctagcgccctctattggacacaggtacactatgccggaggctgtcaaccctcagagttctaacactgtacttagggtggagggcatggtggcagaattgtcacctggactccaaaaaggatactgccttatgcccagagtcttgcaaatatctttattaatacagttcctccatcttttggccctaaccccctcattccctagaggctcaggccacaggccctgcatgtaagtggggggcagtgtgccatgctccctgtagggagtggacagtggcaccccagagatgtccacctcctaatcctggaacctgtgagtatgttgccttggtagtcccstatggtaaaagggactttgcagatatgattaaggatcttgagatggggaggtgatcttggaatatctgggtgggcccagggtcatcccgtgagtccttacaagtgaaagagggaggcagaaggctcagagtcagagggagagttgaatatgcattgctgctagctttgagggtaaaagtggctaggagccaagaaatgcaggagatctctggaagctggaaaaggcaaggaaacaaccatcccccagaatctccagaaggaatgcagccctgccgacaccttcattttaacccggtgttccagaactgcaagatactaaatacgtgttgttttaagccaccagattgtagtaatttgttacagcagcaaactatagcgatgaatacattctgctgatgtctttgtttcctatccctatttctcgctctaggtttacattttaaaactgtttccatctaggccrcgcgctgtggctcgcgtctgtaattccagcactttgagaggccaaggcaggaggatcacttgaggtcaggacttcgagaccagcctggccaacatggtgaaaccctgtctctactgaaaatacaaaaattagctgagcatggtggcatgcacctgtaatcccagctactcaggaggttgagattagaggattgcttgaacccaggtggtggaggttgcagtgagccaagatcatgccactgcactctagcctgggtgacatagcgagactctgtctcaaaaataaaaaaaataaaattaaaaaactattttctttttttttagcgttaaatcgaaagttccctagttaattcccacaattaggaggggcccaccagttccacaaataggaaatctctgcactgctcttgctcrtaaagtgtatttgctttttcataaattgcttatgttctttgagccaccaatggtttaatgtcagaataatatagatcattagagcctctcaagatcccacaaggaactgcactttctcctgtagttaaccatccagtcatccatgcaagaaatatttattggatgctaccatgtatsaggcactgagccagtattgagatgtgaagacacastgcataatctaagcctttacagaggccacagatgttgggtttttatggcttgagaacaacatacattgtttctttccaggaagctaattggggtacatggagccactttgactaagtagcaaggaacaggaactgcacactggttccatcttggcttccaatttgtattcagacccaggcaagagttaaagagttcgatgatagataagcacagatgcaaaacagtacagtccagtgcctytttgcttaggctaatatstgccctctctttatcctctccagccctgccttcctgcctttgacgcagggagctaagggtctgaatgaaccctgttggaggttgcaattaaatctttgtggacaaaggcacacacacrcacacatacacagaatcctcagataacaggaggcaataaatccaacagcacatccacgttcagagaacagtgtccctgctgtcttgctaacagctgccaatacctcactgagtgcctcacaccaacatgggctccaaggtaagatttttctctctccggacaaatttaatctttccttgtgatttgtgtctctrtcagaggattttgactgttaagtaaagtttactattgatttgttggcaaattcctggttttgtttgtttttgttttgggatttgggtgtkygtgtttctctctctttgtagtacttacttcactcactatgttttttaattttccatggcttgtcttttattcttatccatayatatcctaagtcaatttgtattcagaaatacmtcctttayayagagaaatgaaggatcttaagtaattgcatgcatttactggttaaaacttaactgagaatttggttcacttaggaccttggtcacgttaatatgtagtagtgagagggttcttccagccctgggcttagaacagagtacctcagtgtttggggtactcccaacacctgaggctgactattgaatttcagtgataatcatttaaaattatttacttctttaattacaaaagtagctcattattgaatatttagaaatacacagaagataactgaagtcattgattataaataactggcatttgagtatctctctactctctcaaaaatgtgcccatatatttatatttagacaattgagataaasttgaaaacacagtttaatttcccttttttacttaacrttatagtaatagtattttctgtatcattaaaattatttgaaaatataatttttaagagccgcttaataatccaccattaacatgtttgacttttttcrctaagaaaaataattctgcaattgatcattttgagtataagtctttggctgcatctctgaccttttttcttttgtaggatgggttccttgtagtagagttactaagtcaaagagtatacaatttttagggccygayagatttcatgatggtaatctattttaaaatttaaatgagtgatattgttgataccacaacagaagccacgtcaaagaaaatgaaattctccccagaaactcttattacttgaagtttgacaaggtactgtgacttaatgctgactaatgatatgaaatcctraatagasaactaatcatgaaagtcaatattttattttcacagatgaaggcatctttctgatcaggggtttgtagctcaaacaaaagaatgagcgtgcttctagaaccacagagcaagggaacatggtagaggataagctggcaagttgaaaagcgtgggatttcatccmagtttgacactaactgtgcaaccccaaacaaatctcctaaccttcagaggctcggatttcttgtctatgagatgaaggttggtctacatcagtgtttctcagtgggcagcccaagtgacactgtgccacatgaaatattttggggtagcacctagaacaaaggtcatactttttttgcatgccacataaaataactttttgaaacatgatatcaatatctatgttggttttaaaaattttttgagagttaggggtcttgctatgtagtccaggctggactcaaactcctgggctcaagatatcctcccacytcagcctcccaagtaactgagactccaggcacatcccaccatacctggyagtatctcaatattttaaaagagtggatctagaggaaaaagatgaagtaaatgatagtacaggtagtccttagatatgacataaaccatcaaggtgataggcaaataaatgtcggatgtttgaaaaacacagggttaagtgatctgtagagcatctatttttatctggatttatacctagccattaaattcaagggaaattaatggctagatataaatccagacataaatagctagtaagcgatgcttaccaggaaggcattctgggaaccaggtagagttattgagatttataagaagtgaacagtgatacagacatggagatgtttccaaatatcatcctactacttgcaaccctttgcacttttcgttttaatagtgagtttcmttcgtctgggcagactccctcccctcttccataaaggctgcaggagacctgtagctgtcacaggaccttccctaagagcccgcaggggaagactgccccagtccggccatcaccatgctccggmccattctggatgctccccagcggttgctgaaggaggggagagcgtcccggcagctggtgctggtggtggtattcgtcgctttgctcctggacaacatgctgtttactgtggtgggtacrtttgtggstctttgtgctgagggttaatttgctgtgggccccagcaggcagtgtacaccctgcttgagttcaacagtgaatccatctgagaattttcctttttatgctcaaaaacacacagaggttgttggggactggaaaaaagccctgcagaaaatggagtctgacacttgtcaaacacagctaaaagactcaggaggttcaaagagcaggaggtccagagagggtctgactggagaagaggatggcccggagccagaactggctgtgcttttctttctccccacactgtcttctcaaggtgctaatgactccaagtgcctctgaggcagcgagatcttctcacaggggtgcctttctggactctgctctataaaaacagcatattttatttggatatctgatttaktatcaagaccttgccttccttgtggttctttccctcagaatcctgctttttttagttgatactctcctaatcattacattaagttacacccttgtataaatgggcactaaaaggtttctcctcttgggtaaaacatatgtttttaaaaaaggatctttctgagacaagttgttaatccaatacaatcacttctcattattcatagttctgtagttatagttatgctctataaagtcgctgcaaacactgaattagtgaatactgaatcattgctcccagggaaacmacmcacacacacacacacacacacacacacacacacaattataatcttaaatcttaaacatcgtggtacatcgtgttttctttataaaagagaaaaagaagttcagaagtgttaagtgacttgcccaaggcctctccactagcaggtgccagagttgggattcaaaccctgtccaggggtcccagagctgaggctcctctgaccaccctgcccttcctcctcccatcccctcctgtggccaggtctgtgtgagagctggacatgtctgtgaaatgtcgtggtagctcagtgtgtgttggtttggggggttacatgtcaatctaagtgagtaggagagttagccaatgtggaaaccatgaacaatgaggactaactgtataaggtcagaatttagctactttagctaataggataacttgggcaggcacagtcttttagtaggttttaaccatgccactccagataccagccttgggcataaggctgaacctcatcatagtcccctgatcctagtagtggtaagatgacatctgtccttagcccccatcacctgtcctccttgactttcagtagaattgacatctgtccttagccccttgagtttcagtggtaagatgacatcggtccttagcccccatcrcctgtcctctttgactttcagtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctastggaatagcatggatgaatgacactgccagcaccatcccacctccagccactgaagccatctcagctcataaaaacaactgcttgcaaggcacaggtttcttggaggaagagaytacccgggtcrgggttctgtttgcttcaaaggctgtgatgcaacttctggtcaacccattcgtgggccctctcaccaacaggtatctcactgggtgcagtgccccgcagggtacacaggagtaggaggactagaaaagtatagaaagggggttggaagggaaaaagaagaaatactcacttgtatgattccycaggggagtcagctattcggaaagctcgttactcaaagaataacatgttactgatgaaatgttatgggatcagattttcttagtgatatattgagtattgagyaccaagaagagaaccatgaacagcagtgtgctgtgatgttctatcagtgacctggagcatggcttgaatgggaaaagggtatgaatgggacagtcctgttgtaatctagagcactggcttcccaggagttgtattgacgattattctgatattttcaagagatatacactccacctaggctatcmtttctggaaatgagaattttggccctgatctrtggtcatatctgcatgtttgkttgtttgctcatactcatccacatgccctatttcrtctccacactacattcagaggcatgttttaccatacacccaaatagctgyatttctgctcccacttacatttaaaaatgtagtccatgtatgtgagtgcctkttggaattgtatcttttttttttymaattcccttttaggattggatatcatayccccatgtttgctggctttgttatcatgtttctctccacagttagtaagtaatttgcttcctcttttcttcccttcactgattacctttgattttatcaagtgaatgcggtgtagatagcagggtaacctagaatgtaattaggcatctgactaagcagactggaatattggtttaaatgytctgctgtttttggtatgtggactagaacagtagtgacaattcagtctagttggaattggtctattctgctatagaagaacagatattttattcacttcacttcagctggacataatgagagctgtttgaatatgtatgctaygkggtgtgtgtgtgtgtgtgtgtgtgtgtgtgttatatgcatcagtaatcccttgagcaagtttaatacaaactttccatctatgagaagcaatgatattattttgttatgccatggaaaagggcaactcacaaaaaaatggaaattggacaataacatctggaaaattccaaaaagcctactgcttttcagttaagggctttaaaggttaagcttagaaaagtaaatttgctaaagaaacaagaaagagaaagacaaatactctayccaggatcagctaaatgtttctaataaaatggagatgggataaacacagtacatgagaaaagtaagtctggaaattgatgctgagaagtaaaggaagaaggaatgaaaagggttagcgttagcaggttaaggcaggggaaggcagcctgtggatccagccttggttcccgatggccctgctgawcctctgctctccaacaacacacctccttctccctcgcgtttttcttytcttttcttttctttttaattatactttaagttctagggtacaygtgcacaacgtgcaggtttgttaygtatgtatacatgtgccatgttggagtactgcacccattaactcatcatttacatyaggtatatctcctaatgctatccctcccctctcccccgactccatgacaggccccggtgtgtgaagttccccttccggtgtccatgtgttctctgttcaattcccacctatgagtgagaacatgcctctcatttttcttattacctttctgttccttgtctactttctgtcttcctcttcctcaacttttcttctttcccagcacagaacttgattcctagcaacccaatatttaacaagaatttgttgcattctgggctggaaggctgcaaactgcaagaacttgagatgtgaggttgtctctgagaactacgtcttgtttgtgaaattttagtggacttgaagaaaatgaagaaattcaaattagcactgttcatggaacttctagcagttcagcctaagttagacagcaaatttaaaaataataagatgccaggtgccctatttcatcaaatgaggcttaagatttattccaaacaactttatgcagtgcatgtataatgcccagatggccatagtcacataaagaatgaaaagacatgattccagctatcagaagtgtatatgatggttgcctggggagacatgagacacacactgagaagtaagacaatgcggtgtgctagtggatctgagacgttttrgcatgatatccttgcctgattctctgccaagaattcatgtgttaaaagctttacttttaaagtaaactgtatatgttaagtaattattgtttaacttataccaaactatatatgttaaataattattatttccataggatagctgtgttgctatatggagttggcctaattctaaccaaaagaaaatacatttgatgtttagggtatccttgtccaatgttctaaaaaatacttaaaagagattgttgatgcccgttactacccttaaaccctccaccccccaactaggagccatgcctaatgtaatcaagagtgaaatggtggcccatgtaaagggtycaaagtgaaaaaaataattgctttggtattcctaaatagaatgaccaactctcctggtttgcctagaattgaggggtgtcytagtccatttagcattgctataaaggartacctgaggctgggtcatttatattagaaagaggtttgttggctcatggttctgcaggctctacaagaagcatgacaccagcatctgcttctggtgcgggcctcagggagcttccactcatggtrgaaggtgaaggggagctggctgtgcagagatgagagaggaagaaagagagaggagagggaggtgccagcctttttttaaccagcagctcttgagagaactgtagagtgagaactcactcaccaccaaaggaagacattaaagtattcatgagggatccttccccataacccaaacaccttccactgggccccatctccaacaccggggatcaaatttcaacatgagatttggtggggacaaacaacccawgtccacactgtagtgaggggcttcccaggatgtaagacttcctgtttttgtggggtattttgagtttcagttttaaaaacaaggaagttctgggcagaccaagatgagtgggtcactctattctcaaaggacattgggagagtagacagaaaagactggaaataacaaagtctgagaaaagatgctggtggccaggaaagaagagaccaagaatgtgcatctttgggagacaaggagaagttcggtgtgatcatgtctgccgggaagtaatgggagaagattaaaaacacaaccaaagacatctgtaatgaatgggcaaagggattacaattcttctgattcagacacttcgaggagattattcttaccctaggagacattwttctggaattggaggtgagacatgtctggacttaactaccctgaccaccagcaccctctgatttagttttgtgttgcgggaagtcagggaccctgaatggaaggacctgctgaagccatgacagaagaacataaatcatgaagatttcatggacatttattagttccccaaattaatacttttataatttctcacacttgtctttactgcaatctctgaacataaaattgtgaagatttcatggacatttatcacttccccaattatcaatactcttataatttcctatgcctgtctttactttaatctcttaatcccatggtcttcgtaaactgaggatgtatgtcgactcaggaccctgtgagkattgcgttaactgcacaaattgttcataaagcgtgtgtgtttgaacaatatgagatctcagaaccttgaaaaaagaataggataatggagatgttcagggagcaaggggagataaccattaggtctgactgtctgggagcctggcaggacagagccatatttctcttattgttttggatgacatattcctgttggatctcagtttcctgggtgtccatcttcaacasactgcctctcttcamggacaataactagatgttatttttattttgcatttgctacagagtctagcagagctgcgcattcagtataatttaatacctgctgattttgtctggttaaaagatcgttcaatataagatataaaaaaggatctgattgtatcacaagatattrttttctacccaattcctataatcctcgaagcacctacttactgtcactgtactccagatgatcctgtgggacccagcaatggtaaaraccagatctggattttgcacatggacgatccaggagtatgatctaagaaccagtttccagcctaggacactgagcttcatggacatccctcatttcagtggacagaatgttgggttcttggcaagagatgtacagactcagccttccatctgctgtgtggtgactcggtttatacttctgtggtttctcagttttcttgccatttaaatagcaaaactgaggagtgggagattgaaaagacarctcaaaaaacagggaacagtcatcatgctttattaaaaacatatgcatcaagactcatatctgcagtatcacgggcatgttctctggcggctggggaagcaaaggcaatttgctaactgcagttatcttgctattctctctgcccagtgtttgctttttctgggacctatactctactctttgtggcccgaacccttcaaggcattggatcttcattttcatctgttgcaggtaacactggcaactcatcatgcacacacacatgcaggcatgcacacacacacatctcttactacctcagatcctatatttacatggagaaattaaggaaaatgtcacctggataggtagaaattgtgattcagaaataagggaattgggctgggcacagtggctcacacctgtaacccctgcactttgggaagccaaggcaggaggatagcttgattctaggagtctgagaccaacccgggcagcctgggcaacatagtgagagccctatttctattaaaaaaaagagagaataagttagccaggcatggtggtgtgcacctgtggtcccagctacttgggaggctaaagtgggaggatggcttgagcttgggtggtcaaggctgcagtgagccatgattgtgcctctgcacttcagcctgggtgacagagctagaccctaactcaaaaaaaaaaaaaaaaaaagaaaggaattacagagtttctaacagggtccatagatctctgagcctgacataacttcctctgctaatattcagatgcagctagctcaggtcagagcaagcctccagtgaagctatgaagaagggcaggctttcatttagtgccactctatggtcctttttctgtccccctcttagtactttataggaataatcatgttagtactactggtaacaccagcacagttttcaaagtactggtgaatataatatctaatgcaatcttatgaagttggcattttatgccattttacccatagctatgaaggccagagggtccagctgccgtacagcactagcccacactttyttccaggtctgcagtgctttcctgctcttccctgggcacccctgttaaatagaatggtctcwktgtgcctagattttcctttccctgatctgctctgtaacccctcattttgggaaatgtgctaggaaatgataaaatgttatgaaacatggtataatcagacaatggattttctgtgttatccttccagagggcttgcactatcaacaatattctgaacaggagtggacaatgtgggggcttgggggactagggagggtagtacttgaaaaatactacgggttaagttttgtaaaacccctcaaactgaaactctagctaagattgtcactgaagagataacagggtgggaccaagggctctgagaggcggatagaagccccccagggggccagctgcatctgtaactctctgcgcaggtcttggaatgctggccagtgtctacactgatgaccatgagagaggacgagccatgggaactgctctggggggcctggccttggggttgctgggtaagtggcaccagctggagctctgggttcgggagggtgggactctaggaagcaggtgttcccgaggtgtagaagacgagtattttccttcccttgttggcctcatcctatttcaactcctttagaaatatcactgagaaaaggttaaatttccttctccttaagaagctgggaaacacataaacgtcrgagaaaggtccggaagcccagcctgttggaggaagtgagcctccccgatttagaggccactgcttcgcctcggttcccatgcacacagcaccagagcatggctgctgccagatgctctgctaaatctgttacacgcataatctcttttattcctcaccaccaggaatgaaaggaggaatgattttccccattatagagatgaaaataagaatggcgaaaacaccatccaacatcacacagctaggaaacgccacagccaggatacagactccgattttctgggcttggaaacccaagccccaaacgataaaaytaccctttctttgaggctcctccctcatacaacttaattgacaagctacatgctttcacttattacatgccaagcacagtgccagtactgtagggtgggaagccccaggcatagttcctgccctctaggagcttacaagctcatcgaaaacaaaacacctgaaatttcttccccggcctatgccccaccctctagccccatgggaagcagaggaaacagaatccctgttatttgctagtatccatcaacccaaatgcccaagctaaaccctgtgcatcttgaaatcctttatcatgtcccaaatgaataagctcccaaatgaacaagcttgttagatcctcaacagccactcctggctccttgtcacttctgggttagaatctggcagcatcctccctcttgtgtactccctccttccaccacgatgctgcctgaacaatcytcctgagcccagagcaggtgatgtttctcacctgatgtttctccataggccgcaaggccaagtacatgactcatctgcatatacaaggttcctgcatatgcaaggctctacttttctcctcgcaaatattcatactctgctaacacccgctttcttctttttcttctccaactacacactcttttctgacacctctgtgttcttcacacaagcttcttcccctccagatactctacacttggcaaagccctcgtggctgcctgaaattcctgagacattgactgtgctttcattgcatgcaacattttactgtcaaactttcaccatgctttaattatytgtgtccctccctacacacacacacacatacatacacacacgcgcgcrcrcrcrcacacacacamacacamacacttcctccactagaaagtgggcttgatggggacagggatcatgtctccatctctgaattcccagagcctcaggtggagcttagcccctagsaggccttctgcaaatgctcacggggtaaatrtggataattctcactgcaaaggactcaccctcacctctggaatctgtgtctcctatgcctctccagtgggagctccctttggaagtrtaatgtaygagtttgttgggaagtctgcacccttcctcatcctggccttcctggcactactggatggaggtaagtcaccatcagagcctmcagcaggtgacagcccmggtcaggttgggaatgcattatgttgtagtgtcagtcttcactaagartgggcggttyggacatgttttgatggatcarggactgccccgttgtaraaaagaaagaagaaactcagggagttaaattkatgcataatagggtggtagcactacagctgytatkggagcccccagctaatcagtagacacgctgaactgtctcaccttctttgtttcttagcactccarctttgcatcctacagccttccaaagtctctcctgaggtaagcagacacaaagctccatttctaacagttatacaggatggctgaatgcaggaacccaggcatgcctgccaaaccataagaagaaaagtgaagaggaatagggtcagcgaaagtgagaactgtgtttggattccagkatagggttaygtttcaggtagtgtgggggatagtgacgtatttggcttgatgttggacaaagatggtggaagaaccttgtgcataatcaaagaagccatagagaatctatctatctatctatmtatctatatattcgacacatatatggggtrtgtatatatatattcatgtatatctggagatctccatatatatatatatatgtgcacacacacatgtaattatagctaggagataatgacattggggactgagtatttggagctrtaacatcatctcagagatgaaggctgtgggggccacctagacaacatcttctgcaataaaagacatcctstgtgaatatccctaactgtcattctgtcacagttaataaatatcagagttggtacttgtttgactctaagccaaaaayrgctctrgaaaatccatatcccaccacgaaggaaaaaaagtaagaaagtgcatcaagtgtaaaaatgtttgatctaaaggccttgactttgcattccacagcttgtcaaggtattccggaagtcatgacactaacacctcatcattcttcagggcttttcacgcaccaggagctcagcttagtgcgccatctatgctgcatcttacacattccatgaaataagtacaatttttagcctcactctacagataatgaaatcgagggtgaacagagaagcrtctgaaagaatttgaaactatgacataatcaatactttgagtgccaattcccccagagcaactaggagcctcccgcagtctcctgagatgctctgctctttacagactggctttaggagtaggatgtctgggtcctggagagggaagtcataaccaccacccatccaggactyctcagggcaaggagcaccaaataccctctgcacaggctcccaggcctggcatatgcttgggcccagcacccctccagccctggcccaggcgtagggacactcatccaggtggttcagccactgtttattattaactgtgcagcagtggtgaattactcagcaagtaaatccagcttgagattccaggaaagtgaggcacccataaatatctacttttttgagacggagtcttgctctgtcacccaggctggagtacagtggggcgatctcggctcactgcaacctctgcctcctaggttcaaatgattctcctgtgtcagcctcccaagtagctgggattacaagcacgcaccaccatgcccagctaatttttatgtttttagtagagacaggatttcaccatgttggccaggctggtctcgaactcctgagctcaagtgatccatccgcctcagcctcccaaagtgctgggattgtaggcatgagccaccgcacccagcccattctctctctttctaacaaatatacattattattattattactaatgttttgagccagttgacagtagattgattgtatcgttcccttaccccttgatactttagagcattttccctaagaacaggatttttttttatgtaatgtcaatggagctatcaaattcaggaaatttaacatggatataatactttagtctaatttgccgtgcctactctgattgtgtcaattattccgataatgtcttccatggaagtctttttttctctaatgcaaagcccagtccatgactgtgtaagacatttatgcatcacacctctctagcctcttttaatctggaaaagttctcagcctttatctttcatgacattgacatttgtgacaattatctatagggtattcctaaatttggtttgtctgatgtttcttcatgataccgtagccttctgagtttcatgtctggaggtatttaatgcccgtcgcctctcagtggtgatgtccattttgatcactgggtcaaggtgttgtctgggtctcttgtgtagtaattacttcttcaccttgtaactaatayataacmtgtgggagatgttgtaaagtcatataaatctcctactcctccttaaatttcctttctgcctagatttgttatccattgatgattcttgactgacccaatctttactataatgtttacaaaatactggtttttctagttcaccaattcatccaaatcatcagttggcactttgctgtaaggaatagccattcctccaaggcaggcggatcacttgagaccaggagtttgagaccagcctggccaacatggcaaaaccctgtctctgctaaaagtacaaaaaaattagctgggcatggtggtgcacaccgtaatcccagctactcaggaggctgaggcaatagaatcccttgaacctaggaggcggaggttgcagtaagccactgcactccagcctgggtgacaaagtaagactctgtctcaaaaaaaatactctaaaaaacaaaaaagcaatagccattcctttcttactctctttatatgtatatatttataaatatttataccraataggtatataataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctccaactcttgggttcaagtgaccctcttgcctcagcttcttgagtagctgagactacacaggcatgccaccacacccagcttaactttttatagagaccgggtctgcctgtgttgcccaggctggccttgaactcctggcctcccgtccttaattattttgatgctcaaattgtcctagatttgacaagtcaaagcccattaacttgttgctgtgtcattttaacataccttcattgttttttgagtaatgttttacttttcgatacaaaaatatgtcctacgttcatcttgtactttccctgcctcagccctgaattcatttccccaaggagsccaggttcttgttagtagggaatggtgtttagaaaccaaactatggggccgggcacggtggttcacgcctgtaatcccagcagtttgggaggccgaggcaggcggatcatgaggtcaggagattgagaccatcctggctaacacagtgaaatcccgtctctactaaaaatacaaaaaaatgagccaggcgtggcggtgggtgcctgtagtcccagctactcaggaggctgaggcaggagaatggcatgaacccaggaggaggagcttgcagtgagccaagatcatgccactgcactccagtctgggctacagagcaagactctgtctcaaaaaaacaaaaaaaacaaaaaaaacaaaaaactatggggactcaatgtgctctttgccattggggtcaccttgtttccctgccatcttgatgacagagctaatacacacacacaagtttgtactgagacctccacttccagcccaactccacgggatttttccctgcttgccccattccatacatgtattcttctttcaaagtaagaaatttgtctccccctattatacaaataggtgaaacacctattttacaaatagattaaaaaatttacttacttgtataattctataatacttacccatgccattataaaaaacaaagctaccaagaaatattcaagacttttcagttctttttcccttagacttaatgaatatagccaaatactgtatctagaaattaccgtacttccattagttcttttttccacctttagtgtgattatgtaatgcatgatacatttgaaattcatttgcatccatttgtggggttttttttttttggcatttagttttagttttttttctccattctggctaattatcttagtctgttcaagatgccagaacaaaatactacagattgggtagcttaaacaacacatatttattttctcacgactctggaggctgaacgtccatggtcaaggtactgttgagggttggtttctggtgaggcctctcttcctggcttgcagacagccaccttctcagtgcgtcctcacatggcctttactcagtgtgcatgcacagaggaagagagccctgatgtcccttcctctttttataaggaaaacagtttttcagattagagcccccactcttatgacctcatttaaccttaattacctccctgaagatactgtctccaaacacagtcatattaggttaggacttcaacatactaatttgactaaggtggggggactccattcagcccataacactaatataatttatttttttaatatataggacattaccacctaaaagtcaaaattattccaaaaggtgtactcagaaagtgtcaatccctccagtctttctaaccctccccctctcccacccctaccactcrtaggtaaccaattttaatgccttctggtttgtctttcctgtgtcttagtgttttttcctcaaaataaatcgcttatgtgttttcttatttttcccttttctattatatgaaaggcagcacactatgtattcttttttttgcgttctcctttttttctcaataatatgtcctgaaaattactctactagttcacagaatctttccttattattttccacctggtggtrtatatatatatatatatatatatatatatatatatatatakabayacacacacacacacccacacacaattttgtatgtgtacacaatagtgtgtgcgccatattttattccatctcctatgtttaggtagttttcagtattttatagwtataaatagtgctgtaatttgcatgactgcatgtttataatgttgtcattaatctttagagtcaattcctagaagtgggactgttgggtcaaasggtttattgtacttttaaatgtatattttaatgatttacatcagtttctttacttcgaataataattgggtaagcgaatgatctctttagttttaggatctctaaatttatcaatccactattgtgtgtgtgcagagagggttatcataccaaaatgatccaatctattacaagatagaaagtagtaaacaccatgaaggattaggacatagtgttcaggatgtctggaagagagagaagccccagctactgagtcagggagctctctagaaaagaaggagccatttaagcttgactttaaagagtgggtagaacatggaactatggagaagctcagaacgtgtagtttaggcaaaggcaataatgatggctgaggcactgctgggatgcttggaaagagggtggggcgaccaagtttagatgagagtgtgtyctgacgagagtgggtcctggatgtttaggctgtattttaaccctgcttcttctaccttagttcagtgtggctcaaaatgatcagaatgaagaattcagaaagcttgagaggctttctgagttatggcttctgtgcttgcttttgggattcggtgctctgcctgtggttctcccaggacaaatattagtaccagggagatctagtggaaaccaggagtccagacatctattgtccaaccctgaccttgctaccaatccactctgaccttgttgatggtcacgtgaasgcaggaaccatggctggaatatgttgcttctctatctgtgactattacagtgcctacctttcacacaggaggggtcctgcctccagcttcctctgtggcatcagacaagtcactttctctccctrtactggggttcctggtctctgcagtaaaggagatactgtagatggtctctaagcccataattgtaytttctmagattctgtgaaaataggagagatgtatgcactgtacaaatggacattttttgttatccatgttctcagagtgccaaggggactcccctctttatgcttctcaaagacccttacatcctggtggctgcaggtaagctggcgatgacctcccattgggcggggagtgtctgggcttcaagcagccacggctgctcacagaacagtctccccagggtccatctgctttgccaacatgggggtggccatcctggagcccacactgcccatctggatgatgcagaccatgtgctcccccaagtggcagctgggtaagtgacctcagcacccccgctcagggcctggcaggaggaggtgggtgccatgagtcctttcgttcartgtcacacagggacaacatgcttcctttgtagaatgacctcccacgtccacacccatgaatcaagcccaagagggtgtgtggtccctcagagaagcagtctgagaaaggggagggtgagagaggatgaaaggggctatggagaggtcacatacctagctgtgtagtaggatgattaatgatttccagtccaaagattcaggttttggtttcagctcctttgattttctgtgaaaacttgtgcagatgccttaaaccctctgagcatcacttttctcattgctaaaatgagcatcaaaatactatstagttcaagagaaattggatgaataaatgacatatgaggtgaaaatgctttgtaccctgtacaatattaatgtgcaccattaccatccacattctcctcccttcagctcctcatcytcaagactaccctttggttatcttttttacctctaaaaaggggtgtatgtagcactcacttaggaaaagctatgggcccaggagagagggttccagcttcctttgttcatgcagcgacttagagaggagcttggagaggaggatctagcccttcccaggaaccctgaggaaagaggacagggaaggctacgtgcaaattgctccatcactgcagggaggagaggcttacggrgccagaggggaagctgataagaacatgatatagttcagcatgcaataaaaagcactaaatctaattttgggggggcaattctaagcaagactcccagctgcactcctagtgccaaattgaatttttatgggttgcargtgcttttgaccatgacgattaattgagttagtcggtattcagtgcagataattcatcgcctgccctaaggctctgaccactcagggtctcgatactagtgagcagctacaacacagagcagctcctccccagcagcctagggaccattctcagttgccagttaccaattactcagttaccagtcactcagttgccaccatcttttacagctttctcaatgctatctggtctgtaaagtctgacatcaaaggttgtccaacaactacatcagaatcacctagagagcttgttaaaactctgattgctgggagacagtaggcaatttagtcaaaacaagttttcatccctagtaagtctgcaggtgatgctaatatagctggtcagtgatcacacctagaaaatcgctgctgtacatgaagagcatccctcaaaggtgttgggagccaaaggagtccatgcttttgaaagtaatgtgtagtctgcctctgagtgcttgctatgtggsccaccatatactaggtagcatcaccaaggggaggaaatagcccaggtccacctgggtttgaatgctgaccacgtcacttactgattgtgacctcggataagttatttaacctctttgacctctgatatggtgtgaatgtgtcccccaaaatttatatgttgcaaattgaatccccagtgcaacagtcttgagmagtgggacctttgagagatgatgagatcatgggagcaccctcatgaatggattaaggccattatcatgggagtgagtttgtcataataaaaggggagttcagctccctttacatctctctcatgtgtgctctctctccatgtgaccccctttggccatgttatgatccagcaaccaggcactccccaggtggccaaacagacactagaggcttgcctttgaacttcttaacctccagaaccctgagccaaataaatctctttcattgataaatcatgcactctggtattctgttatattatagcagcagaaaatggactaagacagaaaatgggtaatgagaaaccgggctgctgctataacaaatacttgaaaatatggaagcagctttggaactggaaaattggtagaggctgcaataatttggaggagcaggctagaaagagcctgtattkctgtggttaaggcattaagggtgattctggtgagggctcagaagaagaggagagctatagagaaagtctgaatctttttagacattggttaagaggttgtgaccagaatgttgatagaaatatggacagtgaaggtcattctgacgaggtctcagatagaaatgaggaacaaggtattggacactagagtaaaggccatccttgttatacagttacaaaaaacttggcagacttgtatccataacctaggacttcatggaatgaagaacttagaggcaataaactaggatatctrgcagaagaaatatctaagcagcaaagcttcaggctgctttgtggctgttttaactgcatatatagtgacatgtgaaagcaaagaaatgatttaaaggtgaaatttatggttaaaagagaaacaaaacagaaagacttggaaaatttgctgcctggccttggaaagaaagaaaaggcatctttaggagagcacaccaagactgtggccaagcaacctaaagtgattagtgtggataaaagtgagccaggcaccacttattaagactgtgggagaaagacccaaaggcattttagagaccttcgaagctgtgcttcccattactggcccagagatgtaggagggcagaatggtttgggaataagcctgggacaccctccatgggctcactgcccaggaccaccttgggactctgctctctgcgtttcagtgcagtgcccctcaactgtgccagccrtggctcaagtgggcccagatgtggcctggcctcccactctggagggtgcaagtggtaagccttggtggtgtctatgtggtgcaaattttgcacgtgcgcagaatgcaagagctatgggtgcatgacttcttccacctaaatttcaaaagatgccatgcacagccacttccaagatcacggaactgtaggggcaccagcatggtggcctgcaagcacaagactccaacccatgattgctgctgggtagactcagcccggaaagaccacagacatggggctgcctgatgccttaggggtccaaactccactccagtgtgcccaggattttggacatggagtcaaaggcaattattctccagctttaagacataatattgttttctgttttgggctttggactttcrtgggacctgttacccctttcttcttccctgttgcttccttttgaaataagaatgcctgttctatctttgttccaccattatttttgaaagtaggtaaattatcccttggtgtgcataggagagtggttctaggactcctcacggataccaaactcaaaggatgttcaagtcccttacatagaatggcatcgtatttgcatataatctacacacgtacttccatgtactataatcatttctcaatgacttgtaacacctaatgcaatggaaatgctatataaatagttgttatactgtattattttcttttttgtattatttttatcttgtaytgttatttttattttttttcctcatatatttttgatctgcgattagttgaatccaaggatgtgaaacctgcaaatacaaagggccaagtataatttgttttgatttcacacgctcacagctggagggaatttgcctcaggattaatcgtaccttgaatctcacccataactaatttagacaagactctggattttggacttttgagtttacactggaaccacttaagacttctgaaactattgggatggattgaatgcattttgcattgtgacaaggacatgaattttggaggccgggggtagaatgctatgtcctccaaaatttgtgtgttggaaacttaatccccaatgcaacagtgttgagaagtggaacctttagtaggtgataaagtcctaggggcaccacmtttatgaatagattaaagcaattatcataggagtgggttagtcacaaraggggggagtttggcccctttttcttttctctctcaaatgccctttctccatgtgatacccttcggctgtattatgacccaacaagaagtccctcaccagatggccaagcagatgctggtgccatgcacttgcgattcccagcttccagcattgtgatccaaatacatcttttttctttaagaattacccaatctgtggtaatatgttacagcagcaaaaataaaacagactaagaccaacttcagttttttaatttgtaaaaaagtagrtatttttcagagtcattttcatctggaatcctaaatggattagcccagtgcgtggaatacaggatactatcagtaaataaaaaattatttgtacaattttactttaaaccattttgatagtcacaaaatgtgtaatccctcaccccttagagattcactgtgaaaaacagatgtttttcatgcaggggtcatgtatctataaatacatattctggagcacctattttgcacaaaatactgctaaaatgtaagctataatcaggtcytaaagaacgagcaacgtggattgagaaaaatctaattaaggaaattttacaccatttaaaatgatgtcaaggaggtgtatctaggaggctgtaggcttcctagaggtgcttacttccacatactagataaacaattgagtagttttaatttttttaagcaattaaatataaacgaatgggtacagtttgcaacagattgccacctgtccaggatagcctacacaaatacactaaggtgtgcttacttctactccatagaagagaatattaaaagcaaacaagttgtcagccaataaatggttgattgttgacttttaatttaattgtaattgccatggtattttttgttagcctgcactgtttttttctaggtatagagagggattaaaagggctggtgagatccagacaaactcactctgctgatctcaaacagttccttataccagagccatctgtgctaccacgctgggggtgtggcatagtggaaacacttggagttagagtgagatggcctggactcaagtcctgacatgccactcacgagttatgatgataataatcaagaccagtgcttgtagggcccttactctgcgacaggcacgatgcaaaatgtttgatatgcactattttgtttaaacctcacaactggcctgtctggtagaaattatgattatccccatatttcagagatttcttttcttttctttttctttyttttttttttttggcagctgcaagatttaatagagtgaaaacagagctaccatataatgggaggcggcccaaagggaattgccactgctggctggaatgcctggggtttatatcccgatcattgtccctccctctgtgctctcaggtgatagattatttgattatttctttacctcctgcttttagcstaattggtattttagtgagctctctttactatgtgattggtcaggtgtgagctgagttactagccccttgtttaaaggtgggtgtggtcaccttccccagctaggcttaggaattcttaattggcctaggaaatccagctagtcctgtctgttagtaccccctctcaacaggaaaacccaagtgctgttggggaggttggctgatgaccgctctaactgcttcctgccgaactggggcatagtaggggtcatgcagttgaaagttccttgagaggggtgctttcgatgtcatcaacattggagcatgggctagcaggccagtccaggggtctgtagtagatcttagtcacagactgcatctggggytccatttgaagaaccatttatagttttacagcttcaattctggaagagacaaacttaaccaggaggttaagatacagagattgaaatgtatagcctaaagtgcagcgggaggtacatccaacagttagtaggattttggccaaggttccrtcgagcmtagtgagggtgrtattaaataggcttaccaggcaagtatgggtacagagggtcttcaaaggcatacaagaattgagagtcaggatgtacagggatgtagaaaaaggcatccttaaggtccaggactgtgagtcactctgcttcctctggtatttgggaaagcagagtataagggttaggtacagcttggtatagagggacaatagcctcactgataatcctgagatcttgcactaacctccactgtccgttgggtttctggactcctaaaattggagtactgcaggggctgttgcatagttttacaaggccttgggcttttaggtccttaacaatcttttggagtccttgttgggcctcaggtctaagggggtactgcctttggtagggaaaggaggtggaatcctttagtttaacttgaacgggacgggcattcttcgctcctccatattgtccttctgttgcccagacttcaggattaattccctcctcaagcagggcacaacaaacaggtgttccttctgtatgttcaggtgtataatggcccctgcttttgcgagaatgtctctccttaacaaagaagtggggccttcaggcataattagaaaggcatgtgaaaagagcaaagttctccagtcacaacttagtggctgggagaagtatctagtgactgcctgtcctaggacctctcagatagtgacagatctggaggacagttgtcagggacaggagagtaagactgagaaggctgcaccagtgtctaggagacagttaacctcctggccctcaaaggtcaagcatacccagggctctgtgagggtgatgacatgggctggcacttgccctgggcaccctcagtcctgctgctggatcatctgttagtggcttctsactcagaggaccttcrtcccctgggacagtgggccttccagtgattctcttgacataaggggcatagatgagggggtggcttayttctattcggacaatcttttttaaagcgtccttgtagactgcactagaagcaagccctattaggcatttgatttgcccaggctttccatattccagagcctccaaagtccacttgccgagggacatggctaaaggggtggccttctttttctcccgttcgtcccattccacctgctcctcctgatctctattataaaaaactgaggttgccaagttcagtagggtttctaagttttgctctgggcctaaagtggacttttgaagtttgtttctaatatctgcagctgactgagtgataaacttatcttttaagattagttggccttcaatagagtcaggtgacagagaggtatgcttcctcaatgcctcccttagtgtctccagaaaggcagtaggattttcttcctttccctgtgttataatggatatcactgagtaattcatagccttcttcctagttttccttagtccttctagcacgcaagttagcaaatgtctgcggcaccaatctccatgttgtgattctgcatcataatgagagtctacactaggaactgcctactggcctgtggggaatcgttctctttcctctgttgtcaccctatcattgacctgactgagataccagagatcgccaaactctcaggctgcaattatagctgcccttctttcatttggggttagtgtctgatctagcagtaacattatatctctccagaatacatcttaggggcgtttttgccttggggaaaacgtttcccatctgaaaaaagaacatgaggatgccagcacccctagtcattttccgatgagcattagtcctagagtgtcctctatggtcctaatgcttattcctttccagggtgtgtaaccacccagggacatctgcttaccggattagttacrctcaccgatgtagcagtcctgcacctgttttcccgcctttcttgaccacaaagaaaggagtccaggctgctggattmtggtggtccattaccagcgtgcccaacattgcctttgcgatcaggggtgagttcttgagctgggctgcgcaacccagttgccccatcaagatgcattcccataaacaacaattcttatgcaaattcatttcagagagggtgtaggtaaccctttgagtcaggattgagatagagtttttgcccactagggcatttgtccttttcctttgtaggaatacaccctaattattgatcttaaactttttgttgccccggattaagtccttttgggtaagaaatatgagagatggatcctgtttatcctgtgtgcctttttcctaaaagaagaagagcaaggagaaaaagatgggcttactggttttgtaagtactttaaggcttggctgaatgcaaacagctcacacctttgagcagaccaattattaggcaattttcccaactctgcttctacaagagtttccttatcaattactgaatacccattacggttttttccctcagtcacccgggaggaaccatctatcttcctgtccttaagggggtacctcctgagtctggtcagaccttcgtatggtaattaagattaaaatcccctgttaggaaattggctgggttaagggaattttcagtggttaatgttaagtcatctttttttttttttaacagactagccccatactttaagatttttgagttagtaagctacttttttttttttttttgacttaggatagttctgaactggtgaggtgtgctcacaatgaggtttcctctaaaagttatttttctacttccttctgttagcaaagcagttgccactacagattgaatgcatttggggcatccctttaatttactcaattcactttgatactgatctattatgttgtcgcaggcccagttccagtgttaaagtactgggtcatcagttctaaggccctcgccaaggagctgaggcttggagattgtattgcacagggtgggtaagttggatagaaattgagagaggagagtacttacacaatggcagagcaatcctcctagccatttacaaacttgtggcccttgcaagggtggtggggaacgggtcccacataactgcccatgttgagagctgtatacctaaattgggagggacaccaggggcaagactccgtgggttcatagccttggtgcctaaggacacagtgtagagcttccttagatcccctttggagatacaacttgctctaatacttgggagaggaagtgaaagtctgaagcattagtacctaggaggcagggattggaggaagtagattcagaggtaaggagaattctggggctacactttcaagaaagtcatggttggaacccaggaggtatgggtcagaagaagaggtaggggtgcacacatgggcaactatagagtagagacttctggttgcatcatgatcttgactgatcaatgcccggagtttgggatgacagctttctgcctctagtcggccttcggcttcccccaagaaaattgtgaaagcagaagctggttccaggcagaccaatgctcccatcctagaaggattgggtgttgttagaaagccttttcccagaaagcctcccagctgagtcttaagtccagcagccacgctaatcgtttgtaactggctgacaggtgctcggtattttcctctgattctaaggaaggataggacagaatagcaagcaaaagtgatccaatattactcaccactttggagaagccctgtacaggccaccagatgttactggagggtctttgttcttagagctcccaagatggggcgggctgctcctaagatggcagcragccttttgttctctgacctggggttcttggcctcacagattccaaggaatggaacctkgggccatgtggtgagtgttatagctctaktagaagccgtgggtcacagawgagaaccgtggaatgcagtgactagtgttcagctggattaggatgaacctgggcacttaggtgtgcaggaacaatggcaagcttttagcccaatcaggagtggcaatgggtgccttgctggatcagaagtgcagtggacaccctgccagatctggaggggtggaagtcaatggtgggtctgtgatggcagcrctcagccgtggtggacggcgaatgaaagctcagctcgagccagaacaaacacggaccagaagagtgtayagttgcaagatytaatagagtgaaaacagagctcccaaagggggttgccctcagagatttcttgatcttaccaaatttcccagtgctctttcaaatcctggacttgtcatcagcaagcatcctatgccctcatccttttctctgaacatgtctttcatcttcttgccctactgagacccagatgttttctgtgaacattgttttcctgcarcatctagatggaagttcatgttccacaccttgctctcctttgttgcttccgagtcatttcttctctattctccttcaaagatctcagctcctttgaatgtcatgtcgttagattacaccaccgaacccttgtttgttgcaaacatctagtgacctcttagttgtccctcctcattcattaaagctgtcaacatctggtccatgttcttttcacctctactcctgtcaccatttttggtgacttcaatatccaggtggataactgtggatcttggcctcctaattttttaatctactcttttgcaatgatcctttcctccttctcaccttaaccaatttaatcctatttatgccctcactttgtgtattagttcattttgcatggctataaaggaatatctgaggctgggtaatttataaagaaaagaggtttatttggcttatggttctacatgctgtacaagaagcctggcaccagcatctgcctctggtgagggcctcaggaggcccagctcttttaacaaccagctcttgtgtgaacttacagagcaagaagtcactcattaccgtgaggatggggacagcaccacgccattcacgagsgattcattcccatgacycaaacacctcccactcagccccacctttaccactggagatgaagttataacgtgaaatttcaagaggacaaatatcaagcaatatcaccttgatgtcagtattaattatatttcctctgaaatctcaattccaaacaatccagttctcatcttacatattcccttctcaggtgttctaatagtcccatatcaacaattttggaccaaactgggatcaccaattcactgtcctgagtaatttttcttccatcactactcctgtcctcacttctttctttttttttttgagacagagtcttgctctgtcgcccaggctggagtgcagtggctcactgcaagctccgcctctcaggttcatgccattctcctgcctcagcctcctgagtagctgggactacaggtacctgccaccatgcccagctaattttttgtattttttagtagagatggggtttcactgtgttagctaggatggtcttgatctcctgaccttgtgatccacctgcctctgcctcccaaagtgctgggattacaggcgtgagccacagcgcccagcctgtcctcacttctttctttcctcaacttggattcaatggctcatgatggatgtcactcttctgaaactcctcactccctctgggcttgtcacttgccaaaaacttcactctagctaagctatcttgttgcctactccttgtctgtaactgagccatggcatggggctgcaaaaaaaaacgcacaaccacgctgttggtctcaccttatatttatggccacaaacctaaagtgggtttcacattgtccaacaatctttctctaagcccctagttatgtcctccttcttcttttccaaaatgactattttatatttcttcattttagccccatatgcactcccgtcccttcaccatcatcattctcagtggttgactttgcctcctactcattgagaaaacagaagctatgataaaatggaagcaatgagaatggaactgtcgtgtttccatcactaagtgtacccaatatcctgcatctgaacccacattcccagtcttctctttaattatggttggagcatcccagccctgatcaaaggccagactcctcttctcgattccatctcccctcacctacttcattggctactcctcatctcctgtgctatctctgccttctttgctaatgtctaaagataggagtcccccaaggctcagtccttggatctctattctttatttgttctttcataggcaatcccatccatttgcatggctttaagtatctaactgcctgacagctctgcttgratatctaccagtcacttcaaacctctcacgttccccccatgctcttgcacttcaaccagtcttccctatctccagctacccaatcgattaagacaaaaacctaggttatccctgatttctcacttcccctcctcactcccgctatgtctttacccaatcaaacagaaaatgtcaccaacttacctccaaaacctaccattttgttcacttctctccaccatgacttctaatctgaggcaccatcacttttctcttggattctgcaaatagtctgacttccactcttgtcccatgaacccattcttctaggggattttagaaaatataaatccaattatgtcatttccttccaaagcttccattgcccttggaataaccagattcatttctaggaccttcattttctcaccctccactttcctcttatatttcaggcacacagatatcctttctattcttagagcaaactaaatgatttctttaagacatcttaatttccattaggtgctttttattttctgcttgaagtgctctcttttggttattaaggtctcagtttgaatgtcacttccccaaagaagccttccccaaccctgaaatcccagatagcccttctgagttgctctgctatatcaccacattaaatttcatgcacataactcaacacttttcaaaattatcttttttgtgtatttgtttacttgttcattgtatgtctccctcccctggagtgtaagctagctgagggctagaattttgtttgtcttattcaccgctgtattcccagcccccagaatacctgacacatggtcaaagtttgttaaaatgaatgaatgaatgaatgaatgaatggaagagactcagacaggttaagtaaattgtccaaagtcacagagctaacaagtcatcaagccatggtttgaatgcaaaatttggagctttgtgtggctccaaagcccatgtttcctgaacacttccctctactgtcacaaaaagccatgtgttcaggacttcartttacaaaatacttttgcatgcattacctaatttgctccacattgtaacccggtatgatataatcatagctttgctttttccagatgtggaaaccaaggctcagaaaggtttagtaattaatccaagatccctctcagagaaatagaagggctggtaagtagcaaggcaggaattcacttcccaggaattatgtatgggtatgtggcacccaaccacaccacctctgaagctcacattctcacgctgataatcaagggtattttatacatgagaacggctcatcagggccattcattaggaatctaagtggggagctggaagcacattaaatgtactgaggctaggccaggtgtgggggctcacatctgtaatcccagcactttgggaggccaaggcaggcaggatttcatgaccagcctgggcaacatgacgagactccatctctacaaaacaaacaaacaaacaaacaaamaaaaaaaaaacaaaaaaaaacaactaggtgtggtggtgttcatctgtaatcccagccacttgggaggctgagctgggaggatcacttgatcccaggaggtcgaggctgcagtgggctgagattgtaccactgcactccagcctgggtgacagagtgaggccctgtctcaaaaaaagaaagaaaacaaaaagaaaagtactgaggctaaacaaagccttgctcctgaagaaaggagaggtgtgggggtcctatggcaactactgtgggtttgcacaaaggtccccagatcataaaacaaagtggtttggggatcttggaaggttacaggggtggacttcagtgtcttgtacgagacaaggcattttagagtaaattggacatgtcctaaggtaaggatctgtrtccttccacaggtctagctttcttgcctgccagtgtgtcctacctcattggcaccaacctytttggtgtgttggccaacaagatgggtcggtatgtagcctcrggatctggracgaacagtagaaatgtaagatggaagagcgcccgttcctgatcttggaatgatgaacagcttccatacggttgaaagtttaggatgagtacacaccgataaaaacttcccactgggaggatgggcagtgagtgagtggtgarggtggtatggagaatggattgtcctgagctctgagctgattgttatagaagaggcagtggawacatgaggggcaccccttactttccatccatttgctgtccagttgaggagataaaataaccacaacagagaacagctatgaaaaatgcagtactttgggaaagtagttttcaaattatgttctgtggaatcctaaggagttctatagaggcaccccagaggccactgaggaggaagggttgggggccaagagctatgagtctccattctgtcccttcactacaataaggacagctttaattttatctttggagtttagcatcaagattttagaagcactgccataggacatcagagaaggaaagaagtttggtactttctgtgttttttgagacagacctcaaggaccaaataaaataggacaggtaggaggcagtstgagctgggcaacagcatgagttaagtttgagggctacttctaaggaacaagtgcctcctgagtcagctgattcctcctgtaagggaaggaagagtgtgtcccacggcacctcctctgcctttctatagaaaaagggatggagccaggggagwcaaggaaagggcagggagagagctcatttgggtacaaactggtcatgtagggatgctgtcctcaggtcctaaggggttgctgggattagggctggtgggacaggtcagcatggcggtgatggggtacaggtggaggggagctctcccctagtggtgtttgatgatggcttttttcttccaggtggctgtgttccctaatcgggatgctggtagtaggtaccagcttgctctgtgtaagtataagaagacctgggggaggggaaggagagagagagygagagacagacagacagasagagagagagagrgagagagagagrgagagagagagagagaaagacacagacatttaaagactaatttcctttaagatgagcagagatggcttggcaargactgtcagaaagactgtttctgaataggcaggaatttagcacgggggaagaggccaccagctgcagtggctttcctttgaggggaagtgggaaaggagaggaagagggctgtagggcagctggagccggaggtctgaggctgtacatgtgggcatatgaagtgatacatgttggtatccatttctggggatggcaaaatggtgcgttttatgacttcatttactcatcccaccctgacagagcctcataaatccccagggaaccatcatctatgtcccagtctctggcaccagaggcttgatagaagaagaaagaaagaaggacttttccatttccaagaatccccctcaagttctcaaagccttcatttcctcctctccccagtggggatgagaaacacacaaacctcctaggcctgagggagagaagaacagggctacaaggcactgtaaactgtgctcaagaccagctggaggtcctgagcaggagcatgggatccrggttccatggcaggttttgccactttctatgcatgtgactttgagcaggttacttcatctccgtgtgctcagcatcctcatctatgtagagagggttctgatggtgtccacagggttgtcaaggtaatccaaataaaccacagtgtctggcacatggtgagcccatagtgaatctcagccaatactattgatawtttataaacatttcttgaggcatgaaccctaaaaattgttatcagccagcagcatctaaacggtatgctaaacccttaagggktgagtgtcctggggtagcaggtttgaatggcaggtacccagagagggaggtaaggaacctgaaaaagagggaagaaggggtttttgttgggggattgggagggcaatgggaatgagtctcacaagcttcctgacaggggacccaagccacaccacctgccccctctagcttacagctractggttgttggggcctcttctctatcttctttttccaacagctaccaagttagaagtctaaatgaaacctttcagtgatgtccataatggaaaacagaggcaactttattccatgaagaatgagaccaggagtgtatgtttaggtgaagaggggtagaggaaggggagaaagtatccatggaacagaggaagaccctcgttagagcataatggagccaagtctgaggtccaaacttgatcttgccactcattagatctgtaactctggatagagcaataaataaacacaacagcgctggtcaagttttcatatccttaaaatggaggtatagattcttttccatgagaaagtstgagagtgcaggaggatgatgtatgtggccaatagtgcactctgaataaatgcatttcatgtgaaaactctttgaaccttgctcccacctgacccatctggagtcctgatgactcttcctccttccccatgcaggttcctctggctcacaatatttttggtstcattggccccaatgcagggcttggccttgccataggtaagaagtgccctcaaagaaaacaakaagcccctgcatgttggctttgggtctgatgcctttcctcccccttttctcmtcagaggaggtaggtgcagaggcagaaggatcaggagggcagctggcagggttgtggagagatgagctcgtaattcccacctggaacaggtgttagtcygaggcagaagacagcagacaaagcaaatggactaaakggrggaggagaggcggggtggtactaactgtgggtggggctgactgtgtcctgtttgctctggccacaggcatggtggattcttctatgatgcccatcatggggcacctggtggatctacgccacacctcggtgtatgggagtgtctaygccatcgctgatgtggctttttgcatgggctttgctataggtatgttggcaggacctggtgccccactttyccctgtcyactctttaccagctggaagtgcagccaggaagctatcctcctagggttctggagatctttgacgctgagacatcctctgggtcacccactgcccctagcatagtgtcctacgtggaggatgctccatatggaggctccatagacacttatgactttgatgtatccctcccaggtccatccaccggtggtgccattgtaaaggccatcggttttccctggctcatggtcatcactggggtcatcaacatcgtctatgctccactctgctactacctgcggagccccccggcraaggaagagaagcttgtaaggagcaccgactgttaaaagagaaattcacttctgtttctttccatcatctctctcattccctttcaycctgggctgttatttcctccctctattgctctgttgatactctctctgctttgccrtgtttcccaatcccctttcatcttcatatttcttttgtgcacttccttaatttcccttctctaagtaaccacttccctctttctggggctatcaggaagggtcttcagtagagaagggaaatgggggcagaggaccatcaaagacatcctgtagttactgttcttagcttgctagttactagcaagatgtgagttaccaagttaactccctcataagtgggcagaattccattggcacatccgttcatccactcattcactctagtgcaacattatccttaccaggtcacttttttttttttttttgatggagtttcactcttgttgcccagggtggagtgtaatagtgtgatctcggctcaccacaacctctgcctcccgggttcaagagattctcctgccttggcatcccaagtagctgggattacaggcatgtaccaccatgtcyggctaattttttgtatttttagtagagatggggtttatccatgttggtcagcaggtcacgtttttaaaagtacaaaaaccccagggaagagatccataccataggattttctttaataaagcactttcctcttactgcagcacaaacatcctgagggcctgatgggtttgggataccgacagaggctgctcaagggaacaaaagaagacatgaaggtgtgatagggagtggtggtgattccatttggcttcctgctgtaactttcactaccactgttaaattcagttaaaagcaaatgagatacttgtcctgacaagggttgatatactaggtacccsgggaggctggtgcatgtacatgcagagggtcctatgcatgtttcttgagtacttagcaatgccagccttggaagaactagtgggaggacggaatgaggagattggtaaaaaaaagatgtgcggtggttggccgggcgcggtggctcacgcctgtaatcccagcactttaggaggctgaggcgggcgcatcaygaggtcaggagatcgagaccattctggctaacatggtgaaaccccrtctctgctaaaaatacaaaaaattagcctggcgtggtgatgggcgcctgtagttccagctactctggaggctgaggcaggagaacggcatgaacccgggaggcggagcttgcagtgrsscgagattgcgccactgcactccagcctgggcaacagagcgagactccgtctcaaaaaaaaaaaaatgataataatgtgcagtggcttctcttcttgcctctctctgcaggctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgasctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagacctggtaaactagatgttgttttatagcacaagagagtgtatgggcaaatagagcaaatactataaatattatcacactttcctacctttttgaaatacttattgggtgatgggatttcaaagaggtgggagacatggcatccccctaagtagctccccatctgtttgggcaaacagggtgtgaacagtgtaaaacatgattaatgctgcaagttagtatacattctgtgttcaagtatgaacaggtgggatgctcataggctgggtgggaaataatggcagagacagaggtaagaagcaggatggagagacccacacagacaggcttttgggatgcctgaatatcagattggggttttcagactttayctggaatgacaccagggtctgatttttgcactgctctgtaggagtctgaggctccaacacaaaccctgaatcaaagagcacattcaagctgaacctttcaatgaatcttcaccatgcaaatgatagatacctgacttatggatatgtttttagggggctggcattaactagactacctgatttccaaaaccagatgtgttataatcatctttggtcaggatgacatctttctcagactttgaaggagctcaaaggtgaaattataaaattgtttgtcaaaatatataaactgtaagtacacatgcagagtgaatgaatgaccattgggataccttacacaggtggcagtggggtggggcgggatgtggagctctggcaatgacagcctgctgactctgacatccacctggggcagggcttataataaagactgggcttgctacagaaatgaacacatttaaaaaatgggaacaattttttgtcagagaaactgattcctggcttgccagctaacattgtttgaacaatatgcaaagatgtrgataaagggaagccagtggacacaatttgagacttttaaaacaattcttgtcaagggttaacaccaggccgggcacagtggctcatgtctgtaatcccagcactttgggaggccaaggcaagagggtcaytcgagctcaggagttcaagaccagcccgggcagcatggcgaaactccttctctacaaaaaatttaaaaattagctaggcatggtggtacgttcctgtggtctcagcttctcaaagggctgaggcaggagaatcacttgagcccgggaggtggaggctgcactgggccatgatcgtgcaaatgcacttcaacctgggcaatagactgagaccctgactcaaaaaataagaagtcaacaccaaacactgtaaagtaagtcaggacactttttaaaattatagatcagaggtakgttaaagatcatatatatagcgtatatatggaagagtataaaaagaagaattccacaaaaataggaaatgraattagtctttattagtggccttataaagaaggccactaatataaagaagagaatgcacggtaaatttcccatattcacaggtcagatgaatttcttgtaacaatgaaaatgccacccagcaaggatgagccacaagaagttttctatgaaagtatcataaaatggcactccactccactgtgggacagttgaagagatgcgtttttccctcatgaaagggaggaggtgcagagactataaaaatctttgtagaaagacgggctttcaaccaccaattaccatgtagcaaagaagacagtgcaactaacgagctatggtgctcaataagccaggaaaatgttggagtttatcagagcattagaagcaaaccagaagacacatcctttccaaagtacaaaagcaggaaaagtgtggcagttccacattagggtgggagctacagcaccttaaattaaggaggtaactatggaggctgaaggaatgcagagatcacacaggatgatgaatgggtggcaggaacagcagtgtggcaagtgacaggaaagttcttatggggagggacccaaattcaaggggatgttattaaagtagcctacacctttaaggaggcccatttgtgatggccacagtctcagaacaccactggaggaactctaaaatcactagagggctaactctagggtrartattaggaaatacttccccgctacccacccactgtgttcttatgtatggaattgatttttccaagataaagccttagctacataaaataatttttaaaaaaattttagagacaaggtcttgctctgtcacccagactggggtgcagtggtgcaatcatggctcactgcagcctccacctcctgggctcaaacaatcctcccatctcagccttttgagtagctgggactacaggtgcatgccatcacactcagtttatttattttttaaattatttattattattattattatttattattattattattattattttgtagacacagggtcttgctttgttgcccaggcttaaaataaatttcctagtaacattgctccctactcctggaggtagctctgtaatgcttgtacgagtcagtcctctgaggcttacttgaagaaagggcggtgcagcccttccacacaccttccctggatgtgtggttgaytcttggcaagctttgacaccccagggctgctgcgttacacaattcagttctgctgagctcacccctacaatttcgtgtatgggacaggagaactttctctgcaacaaggcaggaatggagcatggtggctttggtacaaagcgctctctgctgtttctgggaggtgctgaagagagaaatggtcaagtcacaaggtggttgagggaggaccaaatcaggaataaagagacataatcctgaggtcctagcctagctctgacattaactagctgtgtgacctgggacaagtcatttcacgtctctgggctttggcatcaacttctgtagctctggctttctgtggctccatctgccactggctcattttggggtggctttctgtgagctcaggggcaggacctgagcgaggagccaaagacaaagctgagaggtcagacaaaggtgagaaccagcatcaccccagaaacacaaacgtcatttcaggtttcatttgttgctttcaagaaattattagaagcaaagtgtgttgtgatcccctcccctcctccttgccctcyttgttgtcctccttctccttatcttcttcctcctcctctcctcgctcctctcctcccctgctgtcccttctccccctcccccctcctcctcctccccctcttcttcctcctcctccctcccccccttgtcctcctctcctcctccctgcttcttcttccccttttttctttcttcttctggagaatgatgagtacagtgttagcagaggcatgagcgtggtcaaggtcttttaggatttgtcatccaaatcgagtcattatgtggtctctggaaatcataagggagaagagtgcagtttggggatcatacattgcttgttttggctattgaccccaggtcagtaattgacaatttttcttcttttctttttcctttcctttcctctcctctcctctcctctcctctcctctcctttcctttcctttccttcttttttttttttttttgagacagtgtcttgctgtgttgcccaggctggggtgcagtagtacgatctcggctcactgcaacctctgcctctcaggttcaagcaattctcctgcatcagtgtcccaaggggtagctgggattacaggcatgtgccaccacgcccggctgattttttgtatttttaagagagacagggtttcaccatattggccaggctggtctcaaacacctgagctcagtcaatccaccggccttggcctcccaaagcgctgggattacaggcgtgagccactgcacccagccagcaattatacctattaggtagaattagggtgtgctgaggggcagccgaccatggtgcaggtcacaacaggttgctgagcaaatcgtcacaggaaagcaggaagttttgtgtgttcaggtgtgactcaacgtgcaggtggcctggtgctcaaagtaggtctgccatgatattcatggaatgacagggagcgggtgggggagcagtgttacagtgttgcaaaccaaagccctctggggaatctccacaacatagaaacaatgtgacagtgaaaactttgttatttgtaacgtgagaataacaatgacacagttgtaacaggagtgtaattaagatgaatgaggtaataagaagyagacaaagaacacactttatcaaccataaacccctatttaaggccagatgcagtggctcacatctgtaatcccagcactttgggaggctgaggagggcggatcatctgaggtcaggagttcgagaccaacctggccaacatggaagaaaccccatctctactaaaaatacaaaaaaattacctgactttggtggcacacatcagtaatcccagctactcaggaggttgaggcaggagaatcacttgaacctgggaggtggaggttgcagggagccaagatcacaccactgaactccagccttggtgacagagtgagactgtctcaaaaaaaacagaaacaaaaacaaaaacaaaaaccccacaaaacttgtttaagtgctactttctattatcagtgagttcaattctcttatcctacagaagaggaaactgatgagatgggtctcactatgttgcccaggctggcgttgatctcctgggctcaagagatcctcccatcttggcctcccaaagtaatgrgattacaggaatgatccactgccaccagccaaaatccattttttttggtaacagctttattgagatacaattcacatgccatacygttcatccatttaaagtatactattcagtggctttaagtatattcacaggactgtgcagccatcaccaccataaattttatattttcatcagcccagaaagaaattctgtgcccattaatcatccctgaattttctttcaacaacaccctccagtcccaggaaaccactaatctttctttctctatagatctgcctattccagacacttgacataaatggaatcatacaatatgtggtcttttgagactggcttgtttcactaagcatgttttcaagatttatcagtatactatcacatctgggattaagtaaaaattaaaaaaaaattaaaggttcatctatattgtggtatgtatcactacctcttttctttttattattaaacgatgtcccattatatgaatatattacaccttatttattcatcttatttcattcatcagctcatgggcatttgcgtcatgttcacctttcagctgttgtgaataatgctgctctaaacatttatgtataarttgttgtgtgggcatatgttctcatttctcctgggtatatacctaggagtaaaattgttcggtcctgtgataacttgatgttaaaactctgaggaactgccagactgttttccaaagtagctttcatatttccacagtcagtggatttcatatttccacagtcrgtggatgaaggttccaatttctccacatccttgccaacatttgttattgtctgtcttttyaattatatccatcctagggggtgtgaaatggtcgcttgtggttttgatttgaatttttctgatgaccaataatgttgagcatcttttcatgtacttattgaccatgtatacattttctttgtggaaatgtctattcagagcctttgtccattaaaaaaaaaaaaaatggttgtcttggccgggctcggtggctcacgcctgtaatcccagcactttgggaggccaaggcaggtggatcacgaggtcaggagttcaagaccagcctggccaacgtggtgaaaccccctctctactagtaatacaaatattagccaggtgtggtggcacgtgcctgtagtcccagctactcgggaggctgagacaggagaatcgcttgaacccaggaggtggaggttgcagtgagccgagattgtgccactgcactccagcgtgggtga

SEQ ID NO: 13306 - DNA, 30192 bp, Homo sapiens
tactcctgacctcaggtgatcgcccacctcggcctcccaaagtgctgggattacaggcgtgagccaccgtgcctggcctgtttccagtttttggctattacaaacaaagctgctgtgaataattgtgtgcaggtttttatgtggacatacgttttcatttcttagggataaaatgcccaggagtgcaattgctgggtcatctggtaggtatattttgtttagtttttcaggaaaccggcaaactgttttccagagtagctggaccactttgcatccccaccagtcgtgtgtgaatgtttcmagttcacagcatcctcaccagtgtttggtgttgtcattattggttatttaattttagctgttctaaagcgktatcttgtcatgggtttcaatttgcatttcactaatggctggtgatgtgagacatcttttcatgtgcttatttgccttctatataccttcttcagggaaaggtgtcatcatgtcttttgcctattttctaactggactgttttttatttatttatttatttatttatttatttatttatttatttagagacagagtctcactctgtcgcccaggctggagtgcagtggtgggatctcagctcactgcaacctccgcctcctgggctcaggtgactctcctgcctcagcttcctgagcagctgggattataggcgcacaccaccatgcctgctaatttttgtatttttagtagagatggggttttgccatgttggccaggctggtcttgaactcctgacctcaggtgatccactttgcttcccaaagtgctgggattacaggtgtgagccatcgtgcccagcctgatttttattttrtatatatatatatgtacacacacacacacaatatacatacacacacatatatgcacacatatgtgtgttaaagctgtatgtaaagctgttatatattacatatatactacatatataacagctttgctgagatataattcacataccataaaacacacccatgtaaaatgtccaattgaatggttttgggtctattcactgaatkatgcaaccatcaccacaaccagttttagaacatttcatcaccccaaaataatctcacatccattagcagtcactcttcatttcctcttacctttcccaccccaccccagccctacgcaaccgctacatctacttctgtctctacagatttgccttttctgaatatttcacgtgaatggaatcatacaatatgtgacattttgtgattggcttctttcacttaatgttttcaaagttcatccatatccaggcgccgtggctcacgcctgtaatcccagcactttgggaggccaaggcgggtggatcacctgaggtcaggagttcaggaccagtctggccaacatggtaaaaccccgtctctactaacaatatgaataattagctgggcgtggtggcggatgcctgtaatcccagtcactcagaaggttgaggcaggagaatcgcttgaacctgggaggcagaggttgcagtgagccgagatggcaccactgcactccagcctgggcaacaagtgaaactcggtctcgaaaaaaagttcatccatgttgtagtatctatcagtacttcattcctttttattatcaaataatattttattgtttaggtctcccatattttctttattcattcatctcttcatggacatgtgggttgtttctgctttttggctttcatgaataatgctgctgtaaacatttgtgttcaagtttctgggtgaacatgttcttatttctcttggttatatatgtaagagtggagatgcaggagtgtatggtaattctatgcttaatctttggaggaactgttttgagacttttttccagagtggctggacaattttatattcacactagcaatatataaatgatttagtttccatacatctttccagtatttgatactatcttttattttagctgttcttatagatgttagtagtgatatctcatcatggtcttaacctgtctaaaggctagtgatgttgaatatctttttagrtaattattttctatccatatatccccttgggtgaaatttctctttatatcttttgccagtcttctaattggatgatttgatttttttatgtagtgtttctatgttgaatttgagagttctttatatatttgttctagataggagtcctttgtcagatatgtggtttgcaaatattttctcttagtctgtaatttgtcttttcattctcttaactaggtcttttacagagcaaaaaaaaattaattttgatgaagttggattgatktttttagggatcatgcctttggtgtcatgtctaagaacacttcatcaagctctaagtctcacagattttctcctatgttatcttccagaggttttttgtttttattttattttactttttaattaagacagagtttcgctctgttgcccaggctggagtgcagtggcaggatctcagctcactgcaacctccgcctcccaggttcaagtgatcctcctgccttggcctcctgagtagctgggactacaggcacgcaccacccaactggctaattttttgcatttttatgtggttgctttygagaattttctctgcctcttgtttttagaagtttgactatgatgtgtcttggcatgaatttctttgggtttatcctgtttgtgatgcgctcagcttcttgaatctgtagacatatgttgtgcgtgtgtgttgtcaaatgaagataatttgcagccattacttcttggaatatttttttaaggcccaccctccttttcctccccttctgggacttcaatgacaaaatgttagatcttcttttattatagttactcatgtccttgaggctttgttccattttctttcatctattttctttccattgttcagaatgggtaatttctattgttatacgttttgtttcactgcttctttcttctatactctccattctgctattgagcccatccattatggtttttatttcagctcttgtattttttagttgtattttttagttctaaagtttccatttggttcttctttatattttctatttctttgctgatactttttattattttatttgtttcaagcacatttataatttctcagtgaaacacttttatgatggctgctccaaaatctttgtcagataattctaacatctgtgtcgtcttgatgtttgtgtctgttaattatcttttgttattcagtttgagaatgcctgattcctagtatgacaagtgatttgccattgaagtcaggatattctgggcactgtgttataagattctggatcttctttaaatattttgttttagtgggcttccctttatactgctccagcgaaataaagtagggcactgcctgattgcttccagacagggataaaagtccaggttctccatccagcctttcctgaacctggggggttgggagagatgaggcctccatgttattgtttggtaagggtagaagttcaggttccccactaggaatccatgacaactccctggctgggagtgggagggatgcttcattactgctccctatgtggctttcactgacactgtgtgtggcagagagagggggrtgcttgttaccactgagtggtggcgaaagtcccaactctccaccaggccccctttgacactactccaatggggccgggtggaatgcctcatttctgcattggggtggcagtggatgtccaggctgcccacatggtttccaccaacaccacatcgggggagggtgatcccagtggggaggaakgtcccagctccaactctagcatcactctggctgagtatgggagtggcctagggttctttgttacagcctggtgaaggtgaatgtctaggttttccatccggcctttgctgacaagggtgatgatggaacttggatggagcggagcaggtatggactaaaagagctctgtctttctaggatgcccctttcctcgttctttggctagaaaagcatagttttgctagaacttgttctgttgggactttttcttgtttgtgccccttggcattttcagttgttggcttctccagtattcagcctgagatatatgaggcaaagagaaatcccagggaattcaccaccattccttaagtcccgaggttcctaaccagtctgcttctctccatctttcagtcttcttatgcttgtcttgtcacgttcaaggttttcagttatacttggcagaataaataaatacatctactccatctttccagaacatcactgctttttgttcattttatttatttattatttactgagacaaggtcttactttgttgcctgggctggagtgcagtggtgctatcatggctgactgaagccttgaactcccaggctcaagcgatcctcctgcctcagcctcccaagtagtttggaccacaggcatgggccaccatgcccagctacttttcattttttgcttttgttgactagccccacagagttttgctrtgttgttcaggttggtctcaaacttctggccttaagcaatcctcttgccttgctctcccaaagcgtattacaggcrtaagtcaccacacccagccctatcggtgcttttggaagaaggtgttcttccctctctctgtttccctccctatggccagctgcccatagagggcagtggtgctggagtgaagacctctcagcgcatccctcttcatctgtaggatgtgcatggcttccaatgctgtctgttctgctcctgagacactcgctggctacaggattataaaggtratgaggtttcagcctaaagactctccattcaataacacttcctacaagatatcttttttgtttttttgtttttttgagacaggatctggctctgtcacccaggctggagtgcmacagcgcgatctgctcactgcaacctcagcctctcgggcttaagtgattctcctgccttagcctcctgagtagctgggaccacaggcgcccgccaccacacccagctaatttttggattttttttttttttttttttagtagagatggggttttaccatgttgcccaagctggtcttgaactcctgagctcaggcaatccacccrccttggccacccaaagcgctaggattacaggcatgagccaccatgcccagtcctacaagatatcttttctttttcttyctttctttctttctttctttttttttttttgagacagagtctcactctgtcacccaggctggactgcagtggtgtgatctcttctcactgcagcctccgcctcctgggctcaagtgattctcctgcctcagccccctgagtagctgggactacaggcgcctgccaaaacacttagctaattttttgtatttttagtagagacggaatttcaccatgttcgccaggctggtctcgaattcctgacctcaagtgatccacccgcctcagcctcccaaagtgttgggattccaggcatgagccaccgcacccggccgagatatctttttcctcctcaatatctatgtgctcctccctcaacccttgggggcttcagtgtaggtggtcagattccccaccatttatgcctatgatgaaaagagtggaaatggtaataactggatggtgtcactaaacyacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttcyacttcccgggttcaagcaattctcctgcctcagcctcatgagtatctgggattacaggtgtacgccaccaygcctggctaattttttgcattttgagtaaagatggggttttgccatgttggccaggctggtcttgaactcctgacctcaagtgatctgcctgccttggcatcccaaagtattgggattacaggtgtgagccactgcgccyggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtrccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcrgagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctkatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgartataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctyggatgtcccatctgaccctsagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattrggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacayctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggawcattgttctttgaaagagagacaagttcatttatcttgcaggcagctgccagggagtcaggwtgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacrcctgtaatcccagaactttgggaggccgaggcaggcggatcacaaggtcaggagatcgagaccatcctgactaacacagtgaaaccctgtctctactaaaaatgcaaaaagttagccaggcrtggtggcaggcgcctgtagtcccagctactcaggrggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgwgcaaaagtgattcaaagtggagaaaagcaggactgcrttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacaraaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtsccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccrgcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggarctgagytggatgtccagtgtgagtagccacggagcctctggttctagggagagaagatggacacrgggaacggggaaggcagatggggtgcagggcattccggggtcctggagtcaagagcaaggagcagccagggtctcctgttcacaactgctgtctcagctcctagcatagggcctggctcatggagggtgctyggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactcyagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttrcgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacaygccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcrgcctcccaaagtgctgaaattacaagcgtgagccaccatgcccggcctcaggaccccatttgacagacgtgtaaactgagacctgcagcccatgcccgtgcrcctctcagcagccgtctggcttcagcgctgtgccctgaacccctgcaccaaaccacagccaggccagagagccagggcagggtttctgttctcacacagatgcaggaaggaygcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctghgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctgrggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagygacgccaaccctcccgtctcccactacacctggtttgactggaataaccaaagcctccccyaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttccttccttyctttctctctttcttttcctcctcctcttcttcccctcctcctcctcttcctcctycttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttccyaaagccctgggattagagccatgagccactgtgcctctccctgtttcctctcatgctcctctctggccctgtctsctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttwaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcargatctcatctctacaaaaaataccaaaaaaaawtttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctrtaawcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccrttgtcaccctcttcctctgcacccctgcacgcatgcaggrgagaaggacgagtctggctgcagagagaagtccaggatgccttccaggcaaaggctgccagggagagctggcccctcagttgattaaggtctctcctttctccacccagatagcccrgagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgyctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggycaggagktcgagmccagcgtagccaacatggtgaaaccctgtctctacaaaaartattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgwgactctgcctcaaaamaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagrcccccactccctgggatgctacaatccaatgatggaagatggcattagctacaccaccctgcgctttccmgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccrctcggcaacaagcctctgrgtaagggccagtctccagaagtggacctgctccttcaagtcagcagcacacatgcscagtccgttcttatcacaaagatcaagasctcrtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggaggrtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcrcacacacacacacacgcasacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaaygaagtagaaaggggcccagtcctggcctggcttctcctttggaagtgaggcattgcacrgggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccarttcttgcacaacccatagctgccagagaaagtcttgaagaccagccaccctgagaaacctcacagcttttctgtcattcgaggtcctctgcacccgttctctaattctgttcactgattcagactttccagttaggtgycccagctcccctctccgcttctcgggtttgatctttctccacccattcacctgcttctgcaaaggggctaaagcccattctccttagagggcaggkgtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctygtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgrgcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcmagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacasctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagagaagatctggaaaacccaatggctccccagggcttcgctcttgctgcaggaggggaaaccacactgctgtggattcttcctccattctgtccatttctcagttcccaacaacacactgaacagtaggaggccagttctccgctcacagcgggcgctgcaccccaggtgckgctctcgagaaaaaggcgagcatggaccaatttagtggctccgaggtatgaaaagcagtgagatggtgtctttgagggagttagtgataggctgagacccccttgctgtcccccctgaagcctggtgaccagagctgccaggaggccacacagagagaggtttatgatgggggacctggaattcggaaggggcagagtggtcaggtgacccatacacgcctgagaaaactgatgtggagagctgtgttgtcattctgaggcaggaaatagagacagactgacagacagacagaaagacacgggcacattgagagacagagacagaatcacagagcagagctggcttctcaccagcaggcgtgggcacacctgagagagcatccagagaggttagaaatcttccttaggtcctcctgggaggctcaggtgaccccagtgggaaacatgaaaggctgggaggacttccagggctgagagaaggaagctacgcagccggccggtgccacattccctgtgccttggggagtgtcccccagtgtccccagccatgcaccctggggggagtcggcttggacatctgtgccaccccttgacaggcagagtgggggccacaacctgggccctccagtgctggtcagcagaggctgcccccgccccttgccttcctcctcccgctccttcctccagccctgggaaggtcggaagccaccaccatggggctagtgcggaagcagagggagaacagaggggccctcctcgcaaaaactaaaacaagcccacagcctgtgcagaaccgcacccgggtgtgatcactccttaccccacacacccactgccacttggagatggcttcatggctgcagtcacagggcaccctgtgttgtcaggggtgagccagtgaggcccgggacctgcccaggggtgcatcaagggtggagaagacctggccccagcgcaggtgtgaacaggcaggagggctggggagggaatagcgctgggttgtggccgagcccccaagccctgctcttgagaggcactggctacacactcggcccctacccagacaggaccccaattcctccctggcccctctgtgttcctgcatcttcccagcccctcacctcctctggcgtggcctcacctccagccgggatgccccattagctgctcacccaagctgctagaacctcaggctaatggccctgtcacccgccctcctccccttccggctcactgcccatcccgggcatcctccatcagcccgctgaggggactgctgagcctcagagacatctggcagcaccaggaggtgggtccctctctctgtggctcctctcttcacctgactgttccccagacccccagaccccctgcccaggtggcccctgagaactgctaagctcaaccgtgacatggatggggccyrgctgacccttgggctctccctgggggacccccttttcctgtccctggccacaccctcaccttatccacacccttctcctccctgctgccccgccggctttccaatgtgggtggggggtgggggcagctcctgccttgccagggaaccagggagggcagtgggctcaggagtcaaactcccattcccagggaaggctcaggctgtgggcccagccctgttctgaattctctccacccctcctccccacagagtctcagaaatcgagaagctttcttcctctgggacctgtgcgccacatcctatctcctgtgacgctgcaggagcttccctggttttaagaggtgacatggtggagagaaagcacaggactgggggccacaggycctggcttctcatccaggctccgctgctccctgactgctgcctttctctgtgggcctcgtttcctccctgatcccaccaggtgaattgtaattctccacacagggctggaacccgcgagtgatcccaggagcccctcctctccggggccccaagatctgaggacagggagccaggttgcacacaggagccgtgcaggccaggacggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcggrggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaacccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgc

SEQ ID NO: 13307 - DNA, 35344 bp, Homo sapiens
gcttgcagaaaagtccagaaatgagtactctgttacagggccaggactagggcgagagcagtgaggcatactactgaggtgcaaaatgtcagggagtgtccaaaaatgcagtaatcaagataaataatacttgaatgcaatgttttaaaatgaaaagttaatgcaaaaaacacatggtgagcaaaatgtcacgttttaaaaataaatatgggatcaggcagtcgctcgcgcctgcaatcccagcactttgggaggccgaggcgggcggatcacctgaggtcaggagtttgagaacagcctggccaacatggtgaaaccccgtctctactaaaaatacaaaaattagccaggcgtggtggcgggtgcctgtaatcccagctactcaggaggctgagacgagagaattgcttgaacctgggaggcggaggttgcaatgagccgagatagcaccattgtactacagcctgggcaacaagagtgaaactccgtctcgaaaataaataaataaataatcgacctttggacttgcacagcataacctcgctgcttcaccctgatcctggctgtgatgaaacaccagcttctggacttttctgcaggtctccacacttttcttggctgtgggtgcagcatctccagggtttggccaaaggggtggtgttctccatgttctctgrctttccaggggacaaacagtgccttctcattcagtcaatggacatttttcaggctggaattctctgacccacagccaagggaagtaatcaaggtggctaggcaggatgtctcctggccaacagaactaacaagagttcaaattcacattacaaggcagctgaagctcctttggtggctgaacctccttgatgcggacttacacccctactgtattcgttaccttttccactctacaaactttggtcactcatccctgcatccattcatccctccttccacccatccatccaacaatacagctgttggtccatcttgccatggacagagccgtctatccagccatcccttcttctattcattcatccacacatgcatccaaacacatagccaggcacccaaccactgagccaatcccctaccgacctaccatataaaatcagcctgtggatgtggaaggagtcccaccycttaccagcaggcctacttaacttctccaagtctcaatctcttcatctgaaaattgagtatgtgtatgctcataagggccttcacagggttgttatgagcagtaaataacaaaacccatgtgaatggtggctattatattaccatggtaagaaaatgaatgtggcraaaggcccagcttgtctgctacaatgttggctctaacaggtgatctggaaaaccagtcaaacctgtagttaacagttgtggggggtgggggaggggggtgataaagttgtgttatcctttttgttatccccagattcagcttaaggaaaagaataaatggatgtggggcaggtaacaatgactagaacattcatgcaggaggcattctgcatgcaggcagtgactgcagattccaggacctgtggttagyggactcctattgatgtttctgggaactctagacctggaagttcaggtaggtaggcaagcctcaggactcatcgtcatcacttgttcccatggggcaaatgctttagtggagaactctggactcaggtagccaggggttcatgcaggggttcaaatcccactcttacttacttgtgtggccttagacaatgtacgtaagtgcctcaattaccccatccgtacaatggggattaagaagtgaagattctgctgatacggtggctcaggcctataatcctagcactttgggaggccgaggcaggtgggttgccggagctcaggagtttgagacccgcctgggcaccatggagaaaccctgtctccactaagatacaaaaaattagctgggcgtggtggtgggcacctgtaatcccagccacttaggaggctgaagcaggagaattgcttgaactggggaggcggaggttgcagtgagccgagatcgtgccattgcactccagcctgggcgacagagcgagactctgtctccaaaaaaactaaataaaaataaaataaaaggtgaagagtcacaaagtttatttgtgtgaggcacttggagcagggtccaacacatccccacaagaggtcatgactctgaccatggataggcctgttctttgcccttggcctcycagcccccatatgcaccagaccttcagaccaatgaggcacctgccagtttgggtgtttcatctggtgtattggtttcttcctattgttgtgttctaattaccacaaacttagaggcttataatagcacaaatgtactctacggaagttctgtaagtcagaagtccatgtggacttggttggttccctggagggtctgggggagaatctgcttccaagctcattcagagggctggcagaatgcagttccatgctggtgaagggctgaggtcctggtttccttgctggctgtcactacggttatttccagcttctataggttgcctgtgtaccttggctttggccctcttcaaagccagcagtggcagatagagtccttctcatgattcagcgctctctgaccccacctgcctcatcccccctctgacttctccracctctccttctgccccctctctccgactcttctcctatgctcttctgcttctaaaggcccacatgattccacagggcccctcggataacccaggataatcctatttaaagtcagctgattcaaacgttgattccatccgcaaagtcctccatggcagtcgctagattgtgcttgagtgaataggaagctttcgagttctgcctaccagccctgtccagccaagactgtgccagcagctgcagtcctcagcctcatttctgtagaggtgyagaggactggaaccacggagaagccctccagccagctggagccagagggtcagacaaactcaccatgaaaagtgtgtgcaggtagcaaaggataaaaagcacacaacggagcatcagaaaagcccatgcatggggggagtctctattctggtgccatgctcagggccaggtattttacctataattatatttaaactgcatgaccgtatctaactaccctggaaagcagggatacttgctccattttacagatgaggaaactgaggctggtgggggggaggcgggggggaaccatttgcttaggtcacacagtgaatctgtagtagggctagaaccaaacattggtctccaattaaccaggtcagtgccctccacatctcagcacccaggggccctggcctgctggaacgatccacaaaggagggtcaccagggacctagcscaggaggcagctctggggcctgaggtctagcatgcagagctttcaattctgacatcctccaagtggctgggatgggcagaggggtgaagcattccaggtacacatgaagggcaggacatctgcctagaaggacacctttatcccaaggccagcgacttctgttccaaatagtaaccgagcagggtcttttctgagacatatgcctcaaagcacagagagactggtcacacccagagaggggcatccagacagagatggagtcacaacctaaggaagatctgctttatctgaaaaaaggtgcctgctggagctcaccctggttccayggagattccatgtccacatgccacactggccacaggagaggagagagactgtgggggaggctctttaaatgcagatttctgagccctacccagacccagtaggtcatatcccaggaaagaagtccaggaatctgcttccccaggtgcctgagacacagagtctgggctagaacatcaggggatgaaacaccagtcggagggaggccacgagagagctcagatctggctctactcacaggttggaaagatgcatttttaaaaagagagggmagggcacagaggctcacatctctaatcctagcactctgggaggctgaggcaggaggatcacttgagcccaggagtttgagaccccatctctactaaaaatacaaaaaaactagctgggcgtgatggtacgagcctgtggtcccagctactcaaaaggctgatgtgggaggatctcctgagcctgggaggccaaggctgcagtgaactgtgatgatgccactgaactccaacctgggtggcaagagagccaggccctgtctcaaaataaataaataaaaatttaaaaatgaagagacagagaaagagcaagcccagagcagagagcactgcagtaggtcaaggctgggttcagacactctctgcgcacagactgggaaagttaccatctactcttgtggcctcagtttcctcatctgtaaaatggggggtcaacaacatgccactttgcaaggtgatgatgtaagtgaagaacagggcatcactgggcatttgaggctacggcacaggctggtctgaatcaccctctcctcacccaaagcagtgacagcaccggcctcctcagcctggaacgcacgttcttctgtctgtctcacacccagacccttacataccatcttctttagctttgcaaactacagagaatggccctacagctcttaatgtagcttcctcagcagaaagactaaaatgtctgttgagggggcaaaacaattcacaaggaggtcgtctagcttcttcagttgtaagtccactccaagcaaaagggaagccagggaaatgtggttaaccagggcagggagacgtggggagtgtgggggaaagtctgaggtggagacacacagggacatggggggtatgaggtggggacaggcagggagatgggggtgcaaggtggagacacgcagggacatgagggggtgtgaggtggggacaggcaggaagatgggaggtgcaaggcggggacaggcagggacataggggtgtgaggtggggaaatgcaggaakatggggggatgtgaggtggggactggcagggatatggrggtgtgaggtggggacaggcagagacatgggggtgtgaggtggggacaggcagggacataggggtatggtggggataggcagggagatggggggtgcgaggtggggacaggaagggacataaggctgtgaggtggagacaggcagggacatggggggtgtgaggtggggacaggcagggagatggggggtgcgaggtggggacaagcagggacatggggagtgcgaggtggggacaggcagggacgtggggcgtgcgaggtggggacaggcagggacataagggtgtgaggtggagacaggcagggacatggggagtctgaggtggggacaggcagggagatggggggtgtgagttggggacaggcagggagatgggggggtgcgaggtggggayargcagggacatgggggtgsgaggtggggacaggcagggacatgggggtgggaggtggggacaggcagggacatagggggtgggaggtgggcacattcagggagatgggggtgtgaggtggagacaggcagggacatagggggagcgaggtggggacaggcagggagatggagggtgcaaggtgaagacaggcagggacatggtgtgaggtggggacaggaagggacatgaggggtgcgagttggggataggcagggagatgggggggtgcgaggtggggacacgcagggagatgggggacgtggggatggcgacasgctgggagagggagaggccaggctgagacctccccgcgcggtgccagccagtccaggcagatccaggactcagccaggcctgatacccagataagcccttcctcccagaggagataagggagcgacgcggccggccgacaggtgaactagagctggcgagttagtcggcgccgccccctcccgcgagcccggcctcgggggagtaccgcccaccccgccccgcgctcgctccgccccgcgctcgctccgccccttcgcgctcccgccgctcctccacgctcgtgccgcccccccccgcgctcccagttgacgctctgggccgccacctccgcggaccctgagcgcaagagccaagccgccagcgctgckatgtgggccacgctgccgctgctctgcgccrgggcctggctcctgggagtccccgtctgcggtgccrccgaactgtscgtgaactccttaggtacgcagagggcgcgccgcccgagagggtgctagcaggccctagagtggackctgggagaacttggccaggggcgcactgggctccggaggaacggggcagagctttccccggtgagaggccaggaactctgcrtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttccycaactggggacacagagtgtcacacagaggactctgatctgtccctgccagaggtgagcaaggacgtcccagccttctctagcagcttcccccgggacttggcacacaggggatcccygtagtgtcttgggagtcccatctgtagagtaggttggacgggctgtttggaacagtgaatccctgtgcaacggcaccagggaaagcactcagaccaacagcgcttttaacagcaccccagggcccatggcgtcaggtggagccccaggactcctcttgttggccagrttggctgcgactggtccagcttcgtgctgcccttgcatcctgtctactgcccgggctcaggcacctcccctggctgaaggcaaggagcctgctcttccctactgcctccctcctttcctactgtccctggtcccagcctcagcccacaggctctgaacttaaagaccacctgcccccttcacmgagaaaagtagccaagaaacaacccaaggagccaagaacctagggagggggggtgccctgagctctggaggaacgggacagggctttcccccagctagaggctcaggggatgggacagagatcactgaggctgaatctgggccagagggttgcctcattccttcccacctatttatttaaaaagctccccagccttgcaaacctcagtgggcgcccagctccaggtcagttcccgcctaaggaaaacctagctgccgcaagcgagggctgcctggagaaggctggcgctgagaggctgtctgaattccagagcagggcttggcaaactttttctgtgaaagaccagacggtaaataacttaggctttatggtggtctctgtagcaactactaactctgccatggtagtgtgatagcaaccatagattgtatgtaagtgagtcagtgtaactgggttctaataaatgatttttatggccactgaaatttcagtttcaagggatttttgggtgctacgaaatatgtttcttctaaccatttaaaattgtaagaaaccgtttgtagcccaggagctgtactaaaacaggagtcagggaccggctgcggtggctcacacctgtaatctcagcaatttgggagaccgaggcagtcggatcactttaggtcaggagttcgagagcagcctggccaacatggtgaaaccctgtctctactaaaaatacaaaaattagctgggtgtggtagccaggtgcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaatggatctattttagggtaaggcacggttcaccagcagattattctggccccagaataatctctccrgaggcaaactggtagtcaattgtcctaaactcaaaccctgcctccaactcttgtcctgagttgaggtctgtcttcctctaaagccctcagctgcagcagggcccttaatcaagatctggaatcccctgaaaccctaaagggagccatgttgaggaaatgtgcattttccccagggaaaacggccatagattggtctctggaacaggttcgagacccaaaaacggagatctaaatgctgtgtggtagtgatcttcacactggaggtatggatccttggggaaacasgaagatatttcaagtgatgccggcagagagtgttctggaaatccatttacagaccttttatttccaagtgtcctctttgctaaaactgggagagagcccctgaaggcaagggggaacctctttcctctcattcaatctgaacctgaacccatgggtataaaaacaatagggacagcaaacaaaaagmcaaaacggtaataaatygttcatatctggcattctcaattcctcaaggaaactgaattgaagaggagaggacttcatggggatatcaactgatgaggtcttaaaaataaygttgagtgaggccaggcgtgggggctcacgcctgtgatcccagcactttggtaggccaaggtgggtggatcacctgaggtcagaagtttcagaccagattggctaacatggtgaaaccccatctctactaaaaatataaaaattagccgggcgtggtggtgggcacctgtaatcccagctacttgggaggctgagatagaattgcttgaaccagggaggtggaggttgcagtgagctgatatcgtgccactgccctccagcctgggcaacagagccagmctccttctcaaaaaaaaaaaaaaaaaagaaggaaagaaagggagggagggagggctgagtgatagagcaccatgggattrgatgcacagaaaggagtgcgaagaattaagtggcrttgctcttaaaaactgcctccattcccagctgcttatttgagcagggtttcccagccctttgacctataagaaacaaaaataagascagaawtaatgctgaaccttttctcaaccaaacaatattcactcatgaaaatataaatccattgcgggggatgggcagtagagtactgtttatcacattaagagatgcatttctgrtacaattttacttttgatgtttaacaattacttttcataatgtataatacatttgaaatgttttaatcagttgggacactaataataattatgattactcaatccagaataaattttttttttttttttttgagacggagtctcrytctgtcgcccaggctggagtgcagtggcgtgatctcggctcactgcaagccccgcctcccgggttcacgccattctcctgcctcagcctcctgagtagctgggactgcaggcgcccgccaccacgcccggctaatttgttttttgtatttttagtagagttggggtttcaccgtgttagccaggatggtctcgatcttctgaactcgtgatccgcccgtctcagcctctcaaagtgctgggattacaggcatgagccaccgcgcccagctccagaataaatttttataatattcacagatgtatgggtcacaggtagtaaaaacatttawttttttttttttttttttttttttttttaracagagtctcgctttgtcgcccaggctggagtgcagtggcacgatcttggctactgcaacctctgcctcccaggttcaagcaattcttctgcctcagcctcccaagtagctgggactacaggtgcatgccaccacgyctggcttatttttgtatttttagtagagatgaggtttcaccatgttggccaggctggtctcaaactcctgacctcatgatccacctgcctcagcctcccaaagtgctgggattacaggcatgagccacggcgcccagccaaaataaataatttaaatttaaactttttgttgttgttgcagaaaagaatgtgaaggtgatcaagcataaaaatgtatgttcccttaggataaaattctgccaggtggggatggagataggtgttcaacaagaaaaagaaactctgtataatatctgactcttttttgtttkgttttctttatttgagatggagtttcgctcttgtcacccaggctggggtgcagtggcacratctcggctcacagcagcctccgcctctcrggttcaagcgatcctcctgcctcagcctcctgagtagctgggattacaggcgcctgccaccatgcccagctaatttttgtatttttagtggagctggggttttgccatgttggccaagttggtcatgagctcctgacctcaggtgatctgcccaccttggcctcccaaagtgctgggattacaggcgtgagccaccacaccccgcctaaatacctgactcttatagaaaagtttgttcatgttactgatggtggatatcaaatcatcatggtatttagattccactggctagctttaaaagaatgatataacaatcttatttttagagatttttttttttttttgagacaaggtctcactcctgtcacccaggcaggaatgcagtggcgctatcatagctcattgcagcctcaacctcccaggctcaagtgattctcccgtctaattttttttatttttttgtagagacgaggtctcactttgttgcccagactggtcccaaactcctaggctcaagggattcrcctgtgtcagcctcccaaagtactgagattataggcttgggccacactgccaggtgttatttttaaatctcaatatttataagttggaatatgtctttggaggtattcaaatttaaaatgaaatgtttagataagaacatacatggggaaatacggcaggaatccaaaaacaaatggctggcctgcttttgtaaaatattttgtcttgtttgttttattatgtttttgataatatctgtacatatttgggggtacatgtgaggtttcgtttttgtgaagtcttgcgggaacgcagtcctacccattaatgttcacagtctctgtggctgtctctgagccgcaggggcagagttgagtagttgtggcagaraccatatagayggcaaagcctgaaatatttactacctgtccccataaggaaaaacagtgcttgcccttggaatagataggtttgttttttgttgttgttgtttttgagacggagtctctctctgtcgcccaggctggagtgcagtggcacgatctcggctcactgcaacctccgcctcccgggttcaagcgattctcctcagcctcccgagtagctgggattacaggcacacaccaccatacccagctgatttttatatttttgtggagacagggtttcgccatgttggccaagctggtcttgaacccctgacctcaggcaatcggcccacctcggcctcccaaagtgctgggattacaggcatgagccaccgcgcccagctggagtagatagctttttaaattaacttcttaccgaaatataacttcatacagaaaggggcacaaatcattgagtatgcatttccacgaattttctcaatctaaacacactcagttaaccagcgcccagttgaagaaacaggatatgagcagcatcccggaagtgctttctgcaccccgacccagtaggcataaccaccatcctgactttcaacaccattgactaatagtatatactttttcacattaatttggggtacaaaaccaggaagagtcggagtttctttttgcattctgcattatataacaccatttttggtgttttaaatttagyccagttttcgaaaatgcaaatcagttctaaagtgccctactttgctatagactcaacattactgtgatgcgcccagacctaattttttttttcttttyacagagaagtttcacttcaagtcatggatgtctaaggtcrgtgcccaacttcttctttttgaagtttttcatttcacaaagtttcctgttatcaaaccaaactgtcccagatttgagacaatgaaaaagggaatttccaactttgcctagtggggtctttccagaagttgaactggccaaacactgggaaagatgcagttaagtaaattccttccaaatagtggtcccaagtgattaacttggctgacagccttccaagccctgggattcatttctgtattttgttttcaaagcacattgtggagaatgtaaatkagtacaaccattgtaaaaaaacagtatggaggttccatcaaaaactcaaaacaaaactaccatatgacccagcaagcctactactgagtatatatccaaaagaaaggaaattagtatattggagggatatctgcaccctcatgtttattgcagaactagtcacaatagccaagatatggaatcaacctaagtgcctatcaatgggtaaagcaaatgtggtgtatgtacacaayggaatattattcagccataacaaagaatgaaattctgtcatttgcagcaacatggatggaactggaggtcattatgtttagtgaaataagccaagcatagaaaggcaaatattacatgttctcactcgtatgtgggagataaaaaagtggatctgatgaagaaagacagtagaatggtgactagcagaagctaggaagggcagggaagcagggatgaagataaactgattcctgagtacaaaatatttttttttttttgagacagagtctcactttgtcacccaggctgaagtgcagtggcacactctcggctcactgcaacctccaccttctgggttcaagcgattctcatgcctcagcctcctgagtagctgggattacaagtgtctgccaccatgcccggctaatttttgtatttttagtagagatgggggttcgccatgttggccaggtgggtcttgaactcctgacctcaggtgatccacccgcctcagcctcccaaagtgctgggattacaggcgtgagccactgcacctggcccaaaaataattagaagaaatgagaccaagtgttcaaaaaacaagtagattcaactgtagtaagcaatcattattttgtatttccaaatagctagtagagaataatttgaatgttcccagcataaagaaatttttaaagtaatggatctcccaatgaccttgatttgattattacacattatatgaatgtatcgaaatattacatttaccaaaaaaagtacatcagttatatatcaataaaaaattatacacatttgtttttagaaaaccaaagcacactgtgtactggttgcagaatcagttggggaacaccagtgcatgtgcttttgaaaaatggtgatctttgctgtaaacttgacccagcaccagcagtggcgtccaggagtgccccacatgtggcaggtttgttcaccagtgcctcttggaccacattctgactttcacgcagctgcatggtcttcattctggccacaggtccctgaaaacggggttgttttgtaacttcccaaatttctcagcagtaccccgcccattaacacagatttggcctgagaatcatagcagaaagaaaaccttcatctttcctcttaggaaaacaaaaaggtctccctctagggagctgcagcctgtttccatgacttgctactggcgtgttttgttttagcaccgtaagacctacagtacrgaggagtaccaccacaggctgcagacgtttgccagcaactggaggaagataaacgcccacaacaatgggaaccacacatttaaaagtacgtggaacgcctyccttccttcctggaaggatgtcagttagtgacccagcccatgaaagggcccgctgggggctggtgggtggagggagcagaagcccaggctctgaagctgtgtttggctgacctcagattgtggctccgctgttactctctgtgtaatgtgggatcgtaaatttgggacaaagccggtacccctctgggtggttgtgaagtttacaagagactctgtagaagcccctgccccattsctgccatctgagggtccagcctggaagccaaggtctgtctttggattgttgcggggggtaggggttgctcatgggctcagagcagcccctgggagcatctgccttcactccggattaatttcactagaaactcacataggccgggcgcggtggctcaygcctgtaattccagcactttgggaggccgagatgggtggatcacctgaggtygggagttcaagaccagcctaaccaacatggagaaaccccatctctactaaaaatacaaaattagccgggcttggtggcgcatgtctgtaatcccagctatttgggaggctgaggcaggagaatcacttgatcccgggaggtggaggttgcggtgagccgagatagtgccattgcactccagsctgggcaacaagagtgaaactccatctcaaaaaaaaaaagaaactcacacgcacgtccagcgtattttctgaggactctgagaaatattggtagttgactaaattggtaataaaggcatcaagcatgagctggaaagaaacttgggcttgaacctcatttctgcccagtcctagcctgtgacctccagggatgctaacatgggcagtaaagaggaaatgagcccaggtgtggtggcccacacctataatccctaaagacagggtcaggagttcgagaccagcctggccaacatggcaaaaccccatctctactaaaaatacaaaacttagccgggcatggtggcaggtgcctgtagtctcagctactagggaagctgaggcaggagaatcgcttgaatccgggaggcagaggttgcagtgagccaagatcgcgtccctgcctccagcctgggtgacagagcgagactctgtctcaaaaaaaaaaaaaaaaaaaagaaaagaaaagaaaaagcagaaatgatcacgcatccctgctggggctgtgtagagaccaaattaggcagcaggtgggaaggcccctggcaccagtggagtggttctttacctagctatccatcagactcacgaggggagtatctaaaaaagyaagtgcccaggccccaccccagaccaactgcattagcatctctggagtacggcccggacatctataccattgaaaaagctccccaggtattttggcagcactgtaagggctgattgaattatctactgaattatattaaatacaaaaacttaaaggagatgggttgcagtggttctaaatacgacacaggtaaacaggaggtttcatcactttttcttgtttcttcattagtgattcactaaccatttctgttttggttttttccttctcttttgtagtggcactgaaccaattttcagacatgagctttgctgaaataaaacacaagtatctctggtcagagcctcaggtaggtataattcattgcaaccaaatctgaatccttttactgaaacctttggaataaatttggagcctgctctgcttctaggcagattcagtcccatccccagatgcagctgagggtatccccagattctttgggggaaccagaagagtcagctctcagcagttcctcagtccaggcccatggccttagcattgtggacccttaacttagggctaccagattaaaatatagatactcagttaaaaatgaatttcagatacacaacaagtaattctttagcataagtatattctaaatattgcacaggatatacttacactacaaagttatttgttgtttacctgaaattcaaatttaactaggtgagctgtatttttatttgctacatctgtctaccctatcctaatgctctggactctcaaggggacatgtcatttagcacttgggaccagtagacaggagagggaaggttctgagagctgcagcctttcttattctctcttggtgattccatgtttatacatttcttcttcttgttgtcagaaaggtttttggttttgtttattttcctgaaaataatgtgtttggttgttccagaattgctcagccaccaaaagtaactaccttcgaggtactggtccctacccaccttccgtggactggcggaaaaaaggaaattttgtctcacctgtgaaaaatcaggtatgcctggcaatctccatcctctccctgcaaaacggccacactcccagacaatacaccaggaagaacaactcaaaaggtccacaaaaccaccacaagcacatccctgcctctgtttcctctcggcatctctccagccctcttcctttgaggggccagggaggtcagcacttctctaggctgctctggaggatgcaaaagttcctctktattgggctaaagtttactcccttccttccccacgccccagattttcccattggtcccaggtctctcctacagagccatccaaaacgttatgttccctgtgcccatctggacaccagaaccccatgcatctcctcttcccgcctccatcttctccgagccaccagggtccagcccctgccctggctggccgcctccctctggttagtccatgtgtcatgcatcagcaagcttctcatggcaggggctggcctccgtggcccttgctgtggggcacagagggcttggcaaggtgagaggccctgccttcctccatgggggagcagtctgggggcatctcagcacaggccctgtcccagagagtctggaccctgcccccgctgttctcccggcctgctgcggcccctcccctagcagggaacctgccgtggccttcttcagaaggatgccgacctctggactctaggaaatatgaggtgaaggtttccttcctggaaactcctggctttccatcgaaattctccatgagaaatgttttttcactttccaaaaagccatccatgcagcacagctttaaagcctcccgggcttgcagtgttcctggagcctgccaagtgctggatgtttaactagcatcaggagccaaagcaaacctccccttgcagcaggaggtggagtagaagcctgcctttgccccgtgacatttttagaccctctgagaaccacatgacaattcagagcaacacgtaacctaaacctgcccaccacttggacaggtgggaaagagaggcccaccaagaattttccaagtcctcctgttaactgatcctgggccatcaggcaggacgcagccggctgggctaagggagcggaatgaggtgcttcctgacgcagatgtgtgccgtctcttactgtggccgctgtgtggggatagagacggacagcagccacagcgtccatcagctcagcaccctccttgagagtttctcactttacagagggagagcctgagagggagggtggtttgcctgaggtccaaggtaagtaagtgacaaaggggactcaaaaccaggcccctgccccaagtcgagcacccaagggtcagccgagctccgcctccttcagcagtgagcttagtctcccccgaagtggccacgtctgcctcgttgactgtctcatggaccctctcaccaggccgtccctccctcccccagctgagagagatatgtgaagggaagagattgggtgaggccagtgtcaacctagggtgatgacctgggaggcaggtaggggacttaagagacatttcagaagtagaagctggaagactgaaccagcaaggtgaggaaacagagatgaacctgagagaaatccttacagcagccaccagcattgtgcccacgggggtgactgcctgaccagcagaatctgacttaaccctgctagcgccctgcaagcaggaaccctcgccattcccactttacaagcaatgaagccaaggcttcgagaggggaagtgacttgcccaggtcacccacctggtgtgtggcagagctgggatgtgaaccaggcaggcaggctgcagccccccacacctaatcctcatgttattctggaggtgttgtgaataagggggctaggcagcggcaatgaactgttagaaggtggggaaatgggtggatggggcgggtcccccagagtctggggtgtcaggggtgtctgggtggggttgtctggcagttagttggatgtctgagcctaagtggaggtcagcactgggctagggtttggggagctgttagtttaacaggactgggcagaagagactggaggtggaaaggtgagagaaggttctaaaaacagaactttggggcatccttctgcagggaaccagtagggaaaagaggagccagtgaagatcgagaaggaagagagccagaagactgcagaatggggtgggggactccaggccctggcagaatggtggggattggccaccaagaggtggtgattgggagtccacaggcactggtcagaggccacctgctgctcctgctcctttgcaagcctctcaggacttgcgaggctcagaatgaatggatctggaacagggcttgcgagcctcagaatgaatggatctggaacagggcctgcgaggctcagaatgaatggatctggaacagggcttggtaaactgccaaggcacctggggactcgggagctctggcagggtcagcagaggaaggcagaaggcagggctgtctcacggcgtccccatcactgatgtcctctgctctcccctggcctttccagggtgcctgcggcagttgctggactttctccaccactggggccctggagtctgcratcgccatcgcaaccggaaagatgctgtccttggtaagaaatcagccacaggcgaccccctgcrgaggacaccccatcctgatgtgggccaggcctgggcctttggtttccctggagcattggctaagggtgctgtttcaggtggacccagatgccccagccttgtggacatctggcatgagaatctcaattgatgcttttcccgggaaggatctgagtttattaaggaaccggcccaagggctcattcctagatggatctgggtggtccttagcttgacagcctggagccttcccggcggaggggttcagaaaggcggagcctgcctggtgggtagccaactaggagctacacccttcccagcagcctcagttgtcttcatgagggaagagccgggacctatgcatccatcccctcgcccacaagagacggatgatgcccctgaaggaactatcctagcccctgcctctgtggagaaaggagggacagtgcacagccggcctggtgatgccatgaggaccctgggttgtggacaggtgggrgtagggtctctggctgggcctgtttcccccatcctatacaccgctgtgggaccccacactctgcatcgtatgggcacacctacggggcaggggtttggacccaacagcccttgccccctctcaccttccctggctgcccctgcttactgagcccctcccgacatgtgccagctgctgggctggcactgcaggacatacagcaactgtccctgcccttggggagtttataatttggtcaccttgacacagcactgacggggcctcagatgtggctcagccagggaggcttagcgcctcacgccaaagccttgacggcttctcagctggcaggtcactgggttgtgtccttcttccaggsggaacagcagctggtggactgcgcccaggacttcaataatyacggctgccaagggtacgtctctgaccagaaggggcccaaaacttcctcatttcccactgaccgcttcgacaggatcymgtgtgtgctgggtctgccacagatataacccaccactgccctgggygatggcaaaatggtctctgttgtacaggggtggtcacctcacatggccaggtctcatagccaggacagggcagagctggaatctgagtccaggcctctgtcctctctccactgtatcacctggctctccacagtgcggttggcctcacccgccaccaaggcctctgggagtgtggccaaaagaatttaatagagtgagcaacacaccattacacatcatcctccaaacccgagatscacacacagatacagggttggcctttagatgaactcactaaagtcccagcctcccaagctcattgcgccctgtgagggtgaggtggctgtgtgtaagggctgtaccttgcctggacctgctttcctggcccactgtaaagcaggttgccaggaatttgctgacatttctacagtgactctagccctcccttcatgcagtgctctgagacatttctgtggtctttgctcacctggcacatggtgtgcataaagccaggctcttggggtgccgtgcctcgactcccctccacctccctggggcacatccctctcccagaccccagcccctctgagctggctcttcctcctgcagggagccgtgctgcagccaagtcctggggacccaggggtgacgtcgtagcctgctctcagatccaccatcatgctcagtgtccccttacttttggtctgtttccactccacagcttagaaacccaacccataacaagagtctgacatttgggcactctggggtcccaccrtttttatttttttttatttatttatttatttatttatttattttttctttttttgagatggagtctcgctctgttgcccaggctggagtgcagtggcgcgatctcagctcactgcaagctccgcctcccgggttcaccccattctcctgcctcagcctcccagggagctgggattacaggcgtgcgccaccacacctggctaatttttgtatttttagtagagatgggggtttcaccatgttggccaggctagtctcgaacccctgacctcaggtgatccacccaccttggcctcccaaagtgctgggattacaggtgtgagccaccacatccagcctgtttttcaaaggagtctatttgctttggttcaggacagtacttccttttctcattcatacaacaaatatcacagagcacccgctgtgtgtaggccctggggatacagcgctcagcagaactggaagagcgggcattctggcaggctcagagagaccacagtcaaggctagactaggtcaggcggtgcggaatgctatggagagaaacagagaagggacggggattgctgggcagctgctgagtttttgtttattctgggaggccacatgatgtagaaaagacccacttttggaaccacttcccagctttagctgtgtggccctggccaggttattcagcctctttgcctcagccagtgacagcatccaccacacagggtcgacacgaggggtcagggagtcatgcctgggaagcacctgcccaggggctcggctgyggcgatgacagtgctctgggctgatgctgttgaccatggtgtggggctgtgcactcctgacagagcggctggccttaaggggtctctatcccactgaggcatgtttgggctggtccttggactccggtggcctcatctgagtttgctgagtcttatcccaaggctgggcctctcagagaccccctctgccactgggacatgcccaaccaagtccccagcctgccaggccagatatctcgccrcgccagtccccgagggccccgcctctatcaggacagccccaggtgggctcacctgtgtgtacttcttgcaggggtctccccagccaggctttcgagtatatcctgtacaacaaggggatcatgggtgaagacacctacccctaccagggcaaggtaactccaacagcctccactctgtcttcttggcgtacagcatgcctagcttcactccctccccagccttggaagacatcccttctcccccsacctccctcccgccggaattctcacaattgtctgttctctccaaattcttccttcccctcctccacccacctgagcccactgctctcaccagtccaggggcctctttatcattctcaccccatacccgctctgcggcaccatctctttccttcccgagccagacttctcaggacccctccttccccccacctgccccatcttcctggctcctctccctcctgccacgagcgccatcctctcgcctctgtccatgcagttggcctcttgtgccaaggaccctttgggggcccacccccacccctacsctatcaaggctgctgggcctcccaccatcacctccgcccagcctggccacagccaagtgccttgtctttccccaagacctgttgctcctcctttatttcccctcgtggtgatgagcagcactggcctccctcagaatttcccaggtgtccacagtcctgttgggccggtccccctctccaccccaccctgccgccagcctgctgaccaccacagacctcacatgactcccttggcccatctgtgtcgctgaccactcagaccggggcctccatccagacccctgagggtggcctcccccaggcctctcaaacccagctcagaccccacgcctgcctcgatcagaatgccgccgaggctccatgcggccttcgggagaaagcccagactccaactcagtctccctgtctcttttactctcccttctttttttttttttttttttttttttgagacggagtcttgctctgttgcccaggctggagtgcaatggcgcaatctcggctcactgcaacctccgcctcccgagttcaagcagttatctgcctcagcctcctgagtagctgggagtacaggcacccgccaccacgcccagctaactttttatatttttagtagagacagggtttcaccatcttggccagactggtattgaactcctggcctcgtgatctaccgcctcggcctcccaaagtgctgtgattacaggcgtgagccaccgtgcccggccaactctcccttcttaacctcacgcccaggcccagccacatgytggttcctaaatgccaggtcctaccctccctctagttctgtcccttgtcctgctgccttctctcctgccttgaaagggctgcgcttccctccttgtgaccttacccctgcacctgcctcttgccagcattgttttttgggctgagactgtccccactcccctgcctcacaggctctgactcggcctccacttctcagtgagtttcctcaggccgggtgaggcccctcctcaggctcccacsacacaccatgtgtgcccacctctgccaaagccagcacaggaccatctgctaccagaccctaagctccttgaggacaaggatgctttaattctctctgaaattatcccatcccccaggccctggcacatcttgttttgtttagtaaatgttattgaactgcgtggggaggctgagacttcgggtccataacctgtatttcatgccctttgcatcctcaacaggatggttattgcaagttccaacctggaaaggccatcggctttgtcaaggatgtagccaacatcacaatcgtgagtgccgatccccctctgggatggggaatgtgtcctgatgaggaggcctctctcatgctgtcggatagccagtgggcccagcaaggcagcccttctggcagcacatccctttgacgagttcatattatccctgggtctcagtcgctgtgatggtggcgaggcaggagatgggagggagagcgcaaactggcaggcaggccctctggttctgaactccagatccacacatgccttcattcttttggttctgttttcttgcttgtaaaatgcaagcaattgtccgcatcctgcagaagagggtatgagcacgtgcttgacacagcgtgtgtgaaactgaggagggtgagtgtgtgtcactcaggatgagccaggttctgttgcaataacaaccgtgcccaatctgcatggctgacaacagtcaaagggtgtgtggcactcctgcgcccatgcacagcttagggagggtggtgtgtgctccgtgtcattggcctcacgccaggactagagggaaagaaggtggtaaatgatgccctagctctaaagccaaaacaagccgcccagtcacagttgacctcaagtgaatagggaagtgtggtcttaccctgcttctcccagagagaactggaacgtgaatgaacgccttcgtgactgcagtgtgcatgcatgcaagtgtgggaggrtgtgtgaggagtggaggaatatmgcttaggttgtgtgtgygcccacgaatgtatgtacagttcacaaacgtgatgtctgtgtaatgacagcggctgccatttagttgaagcatgtgccaagctctcagcaataacatcttaacttgatggagtacttctaggtgctgtaccaaccctcaatacrcactatcycctctagacccgaactggccctaggagatgagtatccttattacctcatttgacaggtgaggaaacgggggctccaagtggttaagtaatgtgcccaaggccacagagctaggaaatagatgctggatttgaactaagaatgtgtcattccagaaccagggctcattgccttgacaacatacagcrcaaatcctgtactcaggatgtcaccctcttcagaatgttgctgctgtcactcaagctggctgctctgggccatgatatcccaaggacaggtgaatttgggcctcaaaggtatccctttgcatggtccccaggagagcctcattggtgacacctgcagggccctgacgaccaggccagaactagcattcagccctcttgggcaggcccatggggtggaaatrgtgccacctgcagaagtcatcgcccctgtgctgggctggcctctgtgccctccatgtctcagatatgccctgacctgttgggctcacaaggccttgtccacataccaggaaggagggcactcccttgccaggcacctgtttgcttttcacagctgggtctctgtccacccctctagggaggcaggactgagggaggctgggcgccccgtccctcctgcacttgctttccttcagtagggccctggcctcagcacaggtaacttcccccctcatttcagctcccagaggtctcttggttagtgcacttgaacccagccacccccaacccagaagctccaaaaagtgccaatgcctgggacccaccctgcagatactgttgtagttggtctgaggcacagcctggacttggggtttttttaaggttctgcatggggttctacctgctgctgtcacctggtctctgcagctctgttccaaagctgcagcctccaggaagccaccctgacttccccccacctaccttcccccttggaggggacaggttctactcagaagtcacacagccctcggatgggtcttctcgtttccaccgccatctgggacctacccgtccatggtttataacccctgtgttctagcagcaaagctttgtagactctgggtttatgggtgtaggggtgagagctgctggcccaggagaggacctcagggaatggatgtgaatgactgaatgagtaggtccacgctgtaccccgtggtccctatctcagagggtgcaggrtttcctaggagcagagttggggagaggaacgagagatggccagacagacccagccagagacaggaagggagagaggccgcaggggagctgcytctggccatccatgctgctctgggcctctagcccctagcttgaggcaaaaggctgtactgtgaaaggagtggggagrtgacaggccatgtgwttctgtctcggtcctgtttccacagtatgacgaggaagcgatggtggaggctgtggccctctacaaccctgtgagctttgcctttgaggtgactcaggacttcatgatgtatagaacsggcatctactccaggtgagtcagggtcccaggagccaggagggacagtggggaggggcytggtgggcctcctcacaccccactygtgggacttgggctcgtggcccagactcctgtgtgtcagacccttcatgacacctgccaggtgctgggcgttttgcacatccctcagttaatcctcacacagccccaagggccaggagccatggcctcttctcacagcaaaggagaggtggtcagaagggatacgacagacacaggccacctggctagtgagagctagggccaaaatttgagagctttgtgctccttaacagaagagttgcctccagtttaaaaaaaacccatgttcaggccaggcgtggtggctcatgcctgtactcccagcactttgggaggccgaggcaggtggatcacttgaggccaggagttcaagaccagcctggccaacatggcgaaaccccatctctactaaaaatacaaaaaaaaaaaaaaagccagcgtggtggtgcatgcctataatcccagctactcgggaggctgagacacaagaatggcttgaacctaggaggtggaagtagcactaagccaagatcgtgccactgcactccaaccttggtgacagagcaaagctctgtctcagaaaaaaaaaaaaaatacccatgtttaaagatttgaagacgtaaaatagggagaagagtagctgccctcacacactaggatcctgtgctggaggagtcaccccaggcttcttcagaaaaaccaagctttagcctctttactatggggtttctctcacccacaccttttcgcctgcctggtttgcagcctcatttccctcccttcatcagttgctgcccgttaacgtcactcactaatgtcactcacgtctgtgctctcctctccctccctgaggctctgccctggtcaccattgtccttggaccccctaaccccccacacactgttccagcttccactgggagctgtctgccttctgaaacactcctcttgccaacgccaacctttgaayacaccagtgtccctgctttcccagggtcctaccctgagggggaccctcatgatctggtcctccctctttttccacactcatctgccatcaaacccgtccccgccgttccaccctgcagcccccaccccagccacgcagaagggttcgcagttccatgggcgttccccgcctccacagggagccttccctgacccaccctgcccaccctcccccccccccccgctgggttggatcccccccacctcctgggggctctgtcgccctcccactgtcagagccctcaggccactgtagagaagcagcctctttgccaacctgctccctgccaaacagggcttycaagggacagttatgcatgctgcctggatcccggcacctggccctggcgcgagcctatggcccacttacacatcagctgaattcacacctgaccactgcagtttgttctcttgaatttcttsgaatttccttatggaggctagttcacttttgtaaacagaaaaagttgtatttttgccataggtataaagtaatatttaataaatgcagtggcaacaaagcaaagctgtgttaaagtctgccagacactgttgcctacagaaggtgcagcaggaaggtggctctctccttgccaggaaagagggagtagaaagtgtcaggggtgagacacgggccagcaccatatggagattctcctgacagaagcagaagaaccaaaagaactgaaagggccgggtgcggtggctcacacctgcaatcccagcactttgggaggccgaggtgggtggatcacctgaggtcaggagctcgagaccaacctagccaacatgatgaaacccygtctctacccaaaatacaaaaattagctgggtgtggtggtgcacgcctgtaatcaggctactcgggagtctgaggcaggagaatcgtttgaaccctggaggtgaaggttgcagtgagcagagattgcaccattgcactccagcctgggcaacagagtgagactccgtctcaaaagaaaaaaagaactgaaaggagttctctcacggagactaaatgtgattacatcaccaccttacatgcctccctggtccrctgtggggaacattgctctaaagcgctcaaagaggcgttgttggatgggactgtcattgcttttatccttcccatatgatcacctctttttgaattttgttttccagtacttcctgccataaaactccagataaagtaaaccatgcagtactggctgttgggtatggagaaaaaaatgggatcccttactggatcgtgaaaaactcttggggtccccagtggggaatgaacgggtaagcagctcccaggtcccactkctgggaggsggatgttgctcaggcctggaggccctgggggcatcacttccacctcagagttackgcttccacrgacgagctggtcagccaagccctaggccaggccagggggaaagggagcatgagaatgtagcctccacatttccaagcccccatttgcagccctcacagggccccaggtctttaggacrctgcagggagagcaggaggccagctggctcagaaggactgctaggaaaacagctcagaacttggaactctgctggcacgaaatcagtgtctgggagggtccgtctttgagaaatcaaagcaacaaatgtacccctgatcactgacagcccctccttccgggagaaaaggctggcatggggcggcctgggtgtatatgctgctgtgcctttgtcctgtcctcccagattccatgtccttgtctgaaaaggagmgctttcctgttccctcgggctcctggtgataaaatagctgtgtgagsgcccggccagggctaagagggggccctcggtaaattttcgggagaagtgggatatggatcattcatttggcagctaaggagagggaagaatgaattcttcacaaagtcaggtccgtgatttgccggtgatcaaataagccraatgctactgttttatgaataaatttagagggtctcacccctgaagtcagctcttggtgagcagcaaaacattctagaaaggcctgtggtggggagaccgccggccgggcctcagctcctctttctgcccaggtacttcctcatcgagcgcggaaagaacatgtgtggcctggctgcctgcgcctcctaccccatccctctggtgtgagccgtggcagccgcagcgcagactggcggagaagkagaggaaygggcagcctgggcctgggtggaaatcctgccctggrrgaagttgtggggagatccactgggacccccaacattytgccctcacctctgtgcccagcctggaaacctacagacaaggaggarttccmccatgagctcacccgtgtctatgacrcaaagatcaccagccatgtgccttagtgtccttyttaacagactcaaaccacatggaccacraatattctttctgtccagaaggrctactttccacatatagagctccagggactgtyttttytgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaacctgagtggagaggtggggaggaaggagaaaaacgggccaagctgcggcagaggcaggattcaaacccacaatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaattctagtaacataagaccacaactgtataagacaaaaaacaatcaccttgctaggcatggtggctcacgcctataatcccagcactttgggaggccgaggcaggtggatcacctgaggtcaggagtttgagactagcctggccaacatggtgaaaccccgtctctaataaaaatacaaaaaaaaaaatttagccaggagtggtagtgcacacctgtagtcccagctactcgggagggtgaggcaagagaatcgcttaagcctgggagatggaggttgcagtgagctgagatcatgccactgcactccagcctcaaaaaaaaaataataataataatagacttcattggatggaattctattctagatttaaaaaaaaactaacatgaaatgaaagcataatttctttttctttctttttttttttttttttttagatgtagtctcactctgtcacccaggctggagtgcagtggtgtgatctcagctcactgcaacctccacctccccagttcaagcgattctcctgcctcagcctcctgaatagctgggattacaggcatgcaccaccactcctggctaatttatgtatttttagtagagatggggtctcaccatgttggtcaagctggtctcgaactcctgacctcaagtgatcccaaagtgctgggattacaggagtgtgagcaaccgcacccagcctgaaagcataatttctgaatttgacaaagattctcaaatcaatggtcagttgtataaaaggattcccattgaagtcagtggtataaaaggattcccattgaagatacatggcaaataagtctaagggtaccattcttgcttacatctatctggaagatctggctgctgtgataaataaacccaattaatatttgcagacagcatgataatgtggctaaaaacattcaggagaatcaacaaaacttagaactaatgaaagagttctgaaagtggctggataccagaaaaaaaaatcaaaaactcagaaaaaatacactattttttgttactattgcaactttactattgcaacaaaaccagcagctaggaataaccaccaaaaagtcttatatgaagaaaattactaaattaataacactataaaggaagacttagataaatggagagccaccatattcttttgttgttgttgttgagacagagtctcacactgttgcccgggctggagtgcaatggcatgatcttggctcactgcaacctccgcctcccgggttcacgtgattctcctgcctcagccacccgagtagctgggattacaggtgcccaccaccacacctggctagtgttttgtatttttagtagagacgaggtttcactatgttggcagattggtctcaaactcctgacctcatgatccacctgcctcgacctcccaaggtgctgggatgacatgcatgagccaccatgcccggccgaggcacaccatattcttgaatggaaagattagcataaataagttgattattgccagaaataaaagtacagatggtatatttccaactaaaatcccaataaaattctgttatcctttttatctgggggaaaaaaggccaaggtagttttataaatgagcaatgagggtggatttttttcacatattaaaatttacaaaatgttaacccttaaaacagtgtgccaattaagaatagattactcactcaggtctaggaagtaagaattcgatacatccgtcacagacgagtccattttcaccattcaattaaaggtgctagaagctgggtgcggtggctcacgcctgtaatcccagcactttgggaggctaaggcagatggatcacgaggtcaggagttcaagaccagcctggccaacatagtgaaatcctgtctctactagaaatacaaaaattagccgggcatggtggcggatgcctataatcccagctactcgagaggctgaggcaggagaatcacttgaacccggcaggcagaggttgcagtgagtggagatcgcacccctgcactccaacctgggtgacagagcgagactccgtctcaaaaaaaaaatagtgctagaaattgaacagtaggttggaaaaacaatgtaacctaaatcctcacccagctctatattgtttttaaagtgaacattttcttttctaacgggtttagatatagaatgactgtggagacagaggagaattcttgcacacccacacccagatctctctgcgatgaatgtagtagtttgatacaaatgtcacaattaatgatccaatatagaacattattaaccacattccaattaaatactcatttaaagggagggtcctgggtgaggttccaaagaaattcaaattaccacaaaaatcaaataactgttttcaaaattagcctcccctgagggatttaggtgctccgcagggattgtgggcttgggctggaacacagacctgagactttgaagcagagttctcctttccataagagccccgaatgtctcaaacccagacaatgatgagagtcttttattataaaaaggcctgcaggcctggtgtggtggctcacggcttataatcccagcactttgggaggccaaggtgggcagatcacctgaggtcaggagttcgagaccagcatggtgaaaccctgtctctactaaaaacacaaaaaaattaccttggcgtggtggcacgcacctgtagtcccagctacttgggaggctgaggcaggagaatcgcttgaacccgggaggcagaggttgcagtgagccgagatcgtgccactgcactccagcctggcaagagagcgagactccatctcaaaaaaaagagggggagggggagggggagggggcgggggggggactttcaggggccaattccctccttttcagccatttaccaaacacctgcagagtatccactgtgtgcagtcctctcctgtgccaggcaccagggagcacacaggatgtttataacatccagtgttggcaggactgttgtgaaacaagcagcatggcctgtgccttggtgctgtttggatttaaagagatcggcagacatggctacatccaactgagataagtaaatttcaaatgcacttgaaccctaaggatgctacagagcctggtacacagcaggtactgcctaattgatctcagtcatcacccctgcccctactccatgacaggccccgtgcggacctctagcaatctcaggcccatggactatgtctttaacactaaggtgctcctgcacttagggaaaagatagcagagttttaaaaaaacaaaaaacagttaaagtccaaaggttaaaaacaaagacatcacaagaaaagaaaactacagagcaatgttccttatcaatacagatgtgaaaatcctcaataaaatactagcagaccaaatccggcaatatataaaaagaattatataccatctctactaaaaatacaaaagttatttaccatctctactaaaaatacaaaaattagctagmcgtggtggtgtgcacctgtaatcccagctgctccagaggctgaggcaggagaactgcttgaacccgggaggtggaggctgcagtgagccaagattgtgccactgcactccagcctgggtaaaaaaaaaaaaaaaaaaaaaaaaaagtattactatatgaacccagtaattccactgctaagagaattgaaaacatgtacacacagaaacttgtacatgaatattcctaacaacattatatataattgccaaaatgkggaaacaacccagatgtctgtcaactgacagataaaatatgatacatccatacaaagaaacatccagcctaagaaggaagtgctgacacacactacaccatggatgaacgttggaaacatcaggccaagtgaaagaagccagacgcaaaagactacacattgtgtaattctgtctatatgagccaggcacagtgggctcacacctgtaatcacagcacttttggaggccaagacaggagaagttcttgaggccaggagttgaagaccgtcctgggcaacatggcaaaacttcatctctacaaaaaaatactaaacaaacaaaaaattagccgggcatgatagcagagcctgtagtcccagctactcaggagactgagaggtgggaggatcacttgagcccaggaggtcaaggctccagtgagccatgattgcatcattgcacttcagcctgagtgaagagcaatactgtctcaaaaaaaagaaaagaaaagaaagaaaaaaaaaaaggccaggcaaggtggctcacgcctgtaatcccagcactttgggaggccgaggygggtggatcacaaggtcaggagatcgagaccatcctaacacggtgaaaccccatctctactaaaaaatacaaaaaaattagccgggcacggtggcaggcgcctgtagtcccagctactccggaggctgaggcaggagaatggcaggaacccgggaggcggagtttgcagtgagccgagatcacgccactgcactccagcctggggacagagcaagactccatctcaaaaaaaaataaaataaaataaaaataaaaaaaagaaaacgaaaaaaagcagaagcctgtgtactcaagactttaaaatttcaagacatgttaattgtgggggctcagggcatgtccctaccatggtcattattagtgtgagtgaactaagcatctcctcccaaaaccatagtgtccgtgacaggaagcccagctcctgccagaatatccagtggaaagaatgctaatggaacacaactttttggaagcagacacacctggattccaatctcagttctcccttgaattttctgtgtgaccttggcggtagtgggggtgttagttaccctctctgagcctccatttcattgtctacaaattgatataatcatattttmttcgtgatttttaaaagttttttaatttttgtagagatggggtttcactatgttgcccaggctggtctcaagctcctggactcaagcgatcataccgcctcagcctcccaaagtgctgggatcacaggcattgagccaccgcgcttggccgccttcacgattttgtggacagaattgagatgatttatggaaatactcagcgtcacatctggctcttagtaagcactcataaaagagagttatctttcactcatttgtccaataatcatgtattaaactgcgacacatgcccagccctgccctaggaggcagaggcggcacacagcaggggcaagtcaggtctactagctgcacctacaaactcatgagcttcctcacccaagtgagtcttttcactttgccctggag

SEQ ID NO: 13308 - DNA, 148935 bp, Homo sapiens
caagtgaaaggaagagttgcatatctctcattttaaatcaaaagctatactttggccaatttaagaaacaaaaaaattaaaagctagaaatgattaagcttagtgaggaaggcatgtcaaaagctcagataaggggccaggtgcggtggctcacgcctgtaatcctagcactttgggaggccaaggcgggcagattgcctgagctcaggaattcaagaccagcctgggcaacatgtgaaactccgtctctactaaaatacaaaagaaattagctgggcgtggcggtgtgcacctgtagtcccagctacttgggaggcaaaggcaggagaattgcttgaacccgggaggcagaggttgcagtgagccaagattgcaccattgcactccagcctgagcgacagagcgagactccatctctacaaaaaaaaaaaaaaaaaaagctaagataagctgaaaaccaggcctcttgtgccaaacagttggccaagttgtgaaggcaaaggaaaagttactgaagaaaattaaaggtgctactccagtgaacatgtgaatgatgagtgaaacagccttagtgtggatatggagaaagtttgagtggtctggatagaagatcaaaccagacacagcattcccttaagtcaaagcctaatccacagcaggaccctaactctcttcaattctgtgaaggctgagagatatgaggaagttacagaagaaaagtttgagatagcaggatttggttcatgaggtttaaggacaaaagccatctccataacataaaagtgcaaggtgaagctgcaagcgctaatgtagaagctggagcaagttatccagaagatctacttaagatcagtgatgaaggtggctacatgatacaacagattttcagtgtagatgaaacagccttctattagaagaacatgccatccaagacattcacaactacagagaagtcaatgacaggcttcaaagcttcaagagacaggctcaccctcttattaggggatattgcagttagtgactttaagttgaatccaatgctcatttaccattctcaaattcctagggcccttaagaatgatgttaaatctactctgccagtggaaaaagcaagagaaccagaactggaagtggggtctgaagatggaactgaattgctgcaatctcatgagaaaacttgaacagataaggaattgtttcttatggatgagcaaagaaggtggtttcttgagatggaatctattcctgggaaagacactgtgcacactgttgaaatgacaacaaaagattgagaatattatataacttagttgataaaccagtgtgagaggtctaatgtgggtaaacactattaaacagcaatgagaaagaacagaaccagaatagtggctctacattacacgcatggcttccatgttgaaagacagtgagacatggctgggcgcagtggctcatgcctgtaataccggcatttagggaggccaaggtgggcagatcacttgaggtcaggagtttgagactagcctggccaacatggtgaaactctgtctctactaaacatacaaaaattagccgggcatggtggcaggtatctgtaattctagctactcaggaggctgagacaggagaaccacttgaacctgacaggcagaagttagagtgagccaagatcacgccattgcactccagcctgggggatagagtgagactcgtctccaaaaataaaaaataaaaaatagaaaaagaaagtgagatataaaggaaacaataacatatgttttttgtttacgtaaaatccaaaaatggatgaaaagaattcatggtagttttttccatatcagctaggtaatgtgccaacatcatagcaaagtttgaggaaggcacaggtcatacatgagcatgaaaacccaatcattatgcctatgaactacaaaagaatcaaagaatctgtggttttaaaaatcagaatagccaggcacggtggctcacacagcactttgggaggctgaggcaggtggatcacgtaaggtcaggagttcgagaccagcctaacatggtgaaagcccgtctctactaaaaatacaaaaattatctgggtgtggtgacgggcgcctgtaatcccagctactccggaggctgaggtaggagaattgcttgaacccaggcggtagaggttgcagtgagctgagatcgcgccatcacactccagcctaggcaacagagtgagacttcatctccaaaaaaataaataaataaataactaaatatatatatatatatatatatatatggaatataattttgtatttaaaatgtacaatacaatttatacttacacgtatcatcttaccacttgctttttttgcttaatattttattttaaaatttattcacattatttccccagttattaagggtgaaaaacttagagcatgaaaaaccaatatgtacttacaataaactgattttcaagttggcaatattatttgcagtggtaaaacctgcatcattgagggtttcccacttcaggattaaattgtgccaatcagccgcattgtccttaatttttcttgcactgacagataagacaggttttctgggcgttacagttccaagagtctttgctgatagggtataaaagaaacaaaattattatcatggaatatacaatcatagttggagggcaaatgtccttataattttcaacagtaaaactatctgaaatgctgtatcaactggacaaataaatgtggaaactacaaagtctgaatgaatgtgaaagttcctggaagaagacaatatagaatatttttaacattttaaaattcaccagatakagctgaatcctcttccagcttaatggctccacaaagtttttaccttaagccctttgttttccaaagattggaaataaggtaaagttgtgactgtctgctaaaactcttcaatggctcacgttcccttccctacaggataatctagccctgactcccgagtacttccactatctagtctcaggcactctgatactttaaatttgctcagagtagcgtggcccatgagtgctaatcatttcaagacactgagacaacagagatgcagagttgatcacgatgctgccactgcccttcttggtaatcaggaggaagtccaaaatccttccagacctagctacccctccacatcatcacgtacatcaacccacaccttggccccccgtcaatatccagcgaaaatgaactactggcagctcttgaaaagctgaggtgcctgcaggcctttacacgtgttctctctgcaggaaagctccttccttcctcaggctcacratgcccatcctccaagatgcacccggatcccactgcctgtaggaagcaacccccagaccaccaagagccaactcaggttgtttgttctccccgaaccctcctgtgccctcttgccttctctactttgaaccccacaaaggcttctcactgcccacaggataaagtcctcttgaggaatccaggacacacaacagctggatggtttgatgcctcaagtcagaagaccacactgcctgcgtctgaaccccagctcgccagctgtgagatcttgggcaacttaatgtacctttcagagcctcaacattttcatctgtaaaatgggaataaaaatagtatctatttcataggattgctgagattagataatatatgtgaagctgtgaggcctcgcacaaggcaaaaacccagtatctcacctgttagctcaagggcctctactatccaagctctgcccaccacttcagcttctaccctttcccacttgccctctgtgcatcagagctggctctgtacaagttctgactttgacctggaatatttttcctatctgtgtgtgtccccactcccctgcctcatacttagtatcctcactttaaaatatcatcttgatttatcattcattctttacttaaacaacaaatatttgcttactgcctacaatacgccaggcatgggggaatgaagtgattgaatgagacggaccaggaccgttttcatggaacttactttccaaaggggaggcagataataaacaaatgaccacgatcagttcagatcatgattaagtgtgtgtggaaaataaaacagggtcttgtgttagtgtgatcccctgagaaggtgtcgtttaggctgagatttgaatgatgaaaagccagaaatagggtaggtcagtagtatgtgccctaattatgataatgaggttggtgagttcaaaaaacagaaaacaaaacaaaacaaacaagcaaacaaaaaaaccagtgtgctggaatgaaatagacagaaaaggactagtgygtgagtaggtgatcagacaactagaacctaataggccaagataagaagttggaccgagggcagtggctcacgcctgtaatcccagcacttcaggaggccaaggcgggcggatcacgaggtcaggagatcgagaccatcctggctaacacagtgaaacctcatctctactaaaaaaatacaaaaaatcagccgggcgtggtggcgggcgcctgtagtcccagctactcaggaggctgaggcaggagaatggcgtgaacccgggaggcggaacttgcagtgagcccagatcgcgccactgcactccagcctgggtgacagagcgagactccgtctcaaaaacaaaacaaaacaaaacaaaacaaaacaaaataaaaaaatgaagtttggacttctaagtattagcttggtgcaaaagtaacagattttgccattacttttaacagccaaaattgccattacttttgcaccaacctaatacaatggggagtgagcaatgagctctggatagggcagtgaaattatctgatttaggtttttagaaagtcatttccacagagaagtattcctggatcccccaggttgggttacgactcaccactagatatgtggtacaccctataattctgctatcatgatattcaccagtggagtgtatttgcttgtttaatgtctatattccctgctaaactggaaattcgactagggtaggaactatgtctcgttctctttcaaaccttccacacataggaggctttgcataaaatgaggtaaatggaggaatagctcttaccacctgttctataattgtctaagggttttccccccaacaggagattctgagggcaggatcacatctgattcayggtcagcctgactcatacggggcacatatttaggaaccaaaaacataactgacttcaagaaactcaagggctggtaaagacagaccagtcatcagcgtcacaggacagggtagggtgagggcacagtggctaagttacttatcccctctgagcctcgattccccatctgcaaaatggggttgacattacttcatgggaccactgtgaggttcaaatgagatgatccacttaaagtgcttggagcagtactcagcaaactgagcactaggcgaaagccagctttcattacaagcagaatgttctgactgagggcagttcagagaggagtttctggacgagatgagcatgcaaggcttggtacccagtgaactctgttagtactaatttatagtgacaataattacaatttggatgtcggatctgctgacactcatttgcgtatatcgtcccgttcatctgtcactgcacatgtgaaaaaacggaggctcggcaaaactgtctcccgagcagctcgcagaggctgcgaggggcctgcgggctaggctggggtaagacagaggacctccatttaacctcatgtaatccggggagctcctgagcttctggtccaacctgcggcctaagcagtaacattcacagccaccccaccccgggaaaggaaccgatctcacgcaccttccataaggtccacagatatccgtagaaggagacgcgaagccccgcccaccccaccggaaacgcatttgcgtcacgtccgccccgcccgctgccacttgtggctctgccgctctagcccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctayctcactccgctccagtttcatcaccagtggaatggagatgagaatagtttctacctctggcttggtaagaggattaaatgggtcagtgcatgtaaagttargcacggtgcctgccgctgtacatttcagtaaaggggagcccctgctgtcatctgtgctagcctgcgttctcgccctctagtyccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagctttkgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcrtgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaargctgatggatgcacaaacaaaacgtgrcctgtctacacaatggaaggctgttcagcaataaaaaggaacraagtactgatttgtgctacaacatggaggaaccttgagaacattaggctargtgaaagcaaccagacacaaaataccacatattatatgattcaattttratgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgakccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaakcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcytgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacytaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcytggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgytgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcayacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcrcatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctytctttttggtgaggatttaatgggtttgtgtgctaagaacagtttgtattaagtacagacggttttcaacttacagagtttcaacttactattttttgactttaagattgagygaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatasaaaacctacagttcaaagagaccataaatccatgatgcaagaagkttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactrcaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctrtagcccccaggtttccctagatgacaaataaacattccttttcctgcgtgaagatmgtctgtggaaaccttggycatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaraaagaaagaaagaaaaraagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcartattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcrtcytagtcacactgctraagatcaccatcttaaaatccatgcacagaggcgtcctggtcacactgctaaagatcaccatcttaaaatccatgcacagaggcgtcctrgtcacactgctgaagatcacartcttaaaatccatgcacagaggcrycctagtcacactgctgaagatcaccvtcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggagkggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcragaccaatctggccaacatggcgagagccccatctctactaaaaatacaaaaattagccgggaatagtggctcatgcctgtaatcccagctactgagaargctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgyttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaawatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattaygtatttttttaactttactgaggaattactagaaatttttggtacatattacacgcataaacacagcaacacaaagatttgttttgagctttggctgccagttattagtggtttaaccccagagatgaattaaatatttatgytgttgttgttgtcattttcatcatgagagctggctgggtcttagaatcatttggtacaatccccactttttatagataaagaaattctaagattcctgcttcaaggcacrtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggkttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggcygggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccarcatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtgggrtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgytttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagacyctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcrgcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggyttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacasacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacraggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctcwaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggycaggtgcagtggctcacatccataatcccagcactttgggaggctgaggcaggtggatctcttgaggccaggagtttgagaccagcctggccaacatgrcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtraatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgktttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgrtggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagacyatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacytaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaataccygagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcarcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcamactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaartgatgctcctgcctcagcctcccgagtagctgggactacaggcgtgtggcaccacacctggctaatttgygtatttttagtagagacaggatttcgtgttakccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagtyagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaataktcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccrtctctactaaaaatacaaaaaaagcggggcgtggtggcgggcgcctgtggtcccagctactcagtaggctgaggcaggagaatcgcttgaacccaggaggtggaggttgcagtgagccaaggtggcgccwctgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttrgaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagygattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgraaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcrattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgccyagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaawaaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccscctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattctyagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagccygcctgcacccaggtgaaataaacagccatgttgctcaaaaaaaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacacttttttttttttttttttttttttgagacatggtcttactcctctcacccaggctggtgcacagtggtgcaatcacggctcactgcagctttgacttcccaggttcaggtgattcycccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactragtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaarggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatwtwtwttttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaawttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgkgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggstcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcckgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcacygcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttaytgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctrtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgcygtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaasggcatcaggagagaacaggagttggggggtcagaggagtcggaggccatatggagggacatagcagctgctgcgagaccgggggctgaggcagcttcgacgggcctgagtctgtagcatggaggctgtgcasagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcrggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcartgasgtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccmctcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcrccaagagaaattgattgacaggaaaggcagaggaagagattatgggctcccttgctggaattcctctggttcgctctatttagaggacatctccaraacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattytggtgtgcgaagaaaccccgcaaataactatctgtttgcctatgtgggtgggccctgggggtgscctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttggrtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgycttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcrggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgygtcacggcccgggctccggctatggaaggctgatgtccacgggactgttcaagccacgtttatcttaaaagatgcttttgccgggggagtcaagcctttwgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggackccrccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttkttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttcyccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggctyaygcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtyagcagaacatgaagttcatcttctcctcattgaagtyttatgaattattatcagccgtacctggtaacactggtttggcagaaagaaaactggcccggggkggggggcagaactagactcgactcttctagcctggttctgcctttaaccaagagtctcttatcggccggagcctggtttgttttcctgtaaaatggggtgggggtrgaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacycagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacarttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtrgtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctrttggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagraaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttactttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaawaaataaataaataaatataaaaagaaagctatggcaaattattttactgattttaatatatgagcttcttgaagaacaaaaactrtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggmtggtctygatctcctgacctygtgatccrcccgccttggsctcccaaagtgctgggattacaggygtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcggctccgggctcctgccccctgggctccaggccacccctgarctgggcaagggcagccagyccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatmcacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcrattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcrggcrgatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctyagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaycgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccrcaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggrgcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacrtcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccaygggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacrctggcttctgtcagtgctagcagtgtgacgctttgtcagtgctcaccatgtgcaggtatcccacaaagcactttagaggtttaactcttttacttctctaaacacgaactataaaataggcactctycttgtccccattttacagaggagaaaatggaagcacagaacagctagacagcttgcacaaggtcacatagcaaatgaagggcgggccccaggaccccctcactcacyctctgtgctgtcatgcctcagaagtgaaacatgctgcttacttgttttgagacaaaacgccataagtctggcttttttttcttctttctttcttttttttttttttttctgagacagggtctcactctgtcacccaggatggagcrcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtrtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagcckagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaaygtgatgtgatgctctaagcgttacatttgcaaaggtgttagaacaggagaaaatgtcatccagggactccagggagtctttgtagggagacagcagcacgcgtctcagaasgtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcarcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttrgatatattccaattatttggcttcctctttaggaattctgttttaatgagctctctgctgtgggtgaacagtctactccctgactctaaaaggaaagtccattcattctttcatgctgctsttaggccattgttagtgaactgsagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcrcactattctcctgcctcagcctccccagtagctgggactacaggcacccgccaccacgcycagctaatttttttgtatttttttagtggacacggggtttcactgtggtagccaggatggtcttgatctcctgacctcatgatccgcccgcctcrgcctcccaaaatgctgggattacaggtgmgagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcrctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgccygcctcagcctcccaaagtgctgggattayaggygtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagrgcgagaytccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtyttgaactcctgaccttgtgatccgcccgcctcagcctcccaaaatgctggcattataggcgtgagccaccggcctcaggagcatgttttaatcactgctgtgagtcgtcagctggggatgartcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagracacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatayagcaaaataccaaaaaaggaaaaataagccaataaccaagtcaaaatgaggtgtggagttctgactgtgtgtctttggggcttcttcccatcttcctggcaggtctgagygtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacycttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctrttcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagcygagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcrtgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccrgccatyctgggtcatcagtgtgtctttcaaaagctgccacccacttgaaccatatctcttgcacagtaatttaactcagasycaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggmaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgktggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtgkttcatgccagtaatcccaacactttgggaggccaaggcagggagatcacttgagcccagaagttcaagaccagccctgggcaacacagggagwcctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaagrcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagyggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacacyctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccacccyccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggctyggtgcagacaacacctcgatgacaaacatgacccctttctgcaggaagcttcctgtggctgtgccagagcagcaaggacctgtgcagcgtcagcgcccagagcgcacagtcgcgrccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgccyggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaraactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccarcctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggygtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggmaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcrccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggyggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatayagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacaatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattayaggtgtgagccactgcgcccagcctcaattttttttttttaaatrcagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttcmatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgyccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacrcctgtaatcccagcactttgggaggccgagacggatcacctgaggtcaggagttcaagaccagcttggccaacatggcaaaaccctgtctctactaaaaatacaaaaattagctggacgtggtggcaggtgcctgtartcccagctactygggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaamcaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccasgaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgcygtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctygacttcctgggcccaaccgatctcagcctccygagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcarttgcaaatgcagcctcatttctttctttgaagtagaaaatcaaagttcatagattagrtgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacacwctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctytgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctcygcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagyaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttrtgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctacygggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagawtggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcrtgatccacctgcctcggcctcccaaagtgctgggattacagacgtgagtcactgtgcccagcctaattttatatttttagtagagatagggtttcactatgttggccaggctggtctcraactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaycccrtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcayaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggkgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgakacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggsgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagagrcattgggcagatggcatgtggccatttccagcagtggggcgcagtgctcagggagactgcagcatcctggagccctgccagccaggagggactgttcccattgcgggcagaatctgttacttgcaatcagaagaacttcarctaatacttgttttttgcctgtagattcaattgaccttgggaatgttgcttaaactcgcctttcactttcaytttcctatcagtaaagtgaagggtcatatccacattagagccatcagaggagcttattaaaaatgtccaggcctcggccctccctggagatatgaattcagcaggtctggggtgaggcccaggcatcttggttggttttttttttwttwttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggttttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacrcccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttcttttttttttttttttttttttttgagacggagtctygctctgtcgcccaggctggagtgcagtggcatgatctcggctcactgcaagctctgcctcccaggttcacgccattctcctgcctcagcctcccgagtagctgggactacaggcgcccgcyaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggtttttgttgttgtggggttttgttttgttttgttttgtttttgagacagggtctctcactctgtcacccaggctggagcacaatggcgcaatcacagctcattgtagctttaaacttstgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtytgctctggctgaaggcctccttttccttttcttttttttttttttttttgagttggtgtttttgcccttgttgcccaggctggagtgcagtggcgcaatctgggctcactacagcctcygccccccgggttcaagcgattctcctgcctcagcctcccacgtagctgggattayaggcaccyrccaccaygcccggctaattttgtattttyrgtagaaatggggtttcaccatgttkgycaggctggtttcgaactcctgacctcaggtgatccacctgccttggcctcccaaagtgctgggattacaggcattagcyactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcrggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtrtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaatamaatcttgtacataagccagatgtgttcaacaagtaacagcaaaactggtcccatgaaactgccccttccacaggggccctgaggcacctctgcaaggccagggccccacaggcrctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgtttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagarctgggattataggtgtaagccactgtgctcggcctttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttgstcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttrgtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggyagttctgggtgggcagaaacaagtgttttgtttgcagttgaggtttccccaaaacccagcatgtgtgggtgctcatttgtcgaacaaatgatcacatgcctccaattaraggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctscatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttmcagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagcyagcggtggggacttgccttgagtgcgctccaggtggtccctggggactcggtcctggcacccctgccctcctggattgcatcccacagccctgctggccrccccgccccagcctccctgctgtgacaggggcaggggctgcggtgaccctgcagcacaggcgcggctccctcggatcccttggatctcaccggtgcatctgrggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggwaacaagagcgaaactccgtctcaaaaaaaaaaaamaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccasgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcscggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacatyctggagacaagtgaccatctcccccgtgagactggcactaggggcaggacgtggcctctctgcctcctgcggggcccacactggctgctgcatgctgccactaacatgtccccagttccggaagtctcctgtcckttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccargccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggkgctctcraagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgygcccaagctcccagctccatctgtgcccaagctcccagctccatctgtgcccaccccacaggctgtgtgattgacaagtatgtgattgrctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcrgagtgactccctggtggacgcrctgyctcaacacttgtccagacacctctggccaggttggacccgcacacttactttcatctatgttggtttctgtctcgttccagaacccacagcctccacccrtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcrgtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcrcwcttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcytgagcytgcactgtcctygcctgcagcctcagaggggcaggcatccccgcacagacttgactggcagggcggtcacgggacytgcgggctggctccgagtggcagcccatgccttctgcrgggtatgggttgacacttgacaggttgaaaccagtgcctctatggacggctgctgtggccccttcagacaatgggcagtgcccaccccgcccactggcrtctgcgtgtgagggmtaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagrcaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatgccagaatgctagcagtgcttgtatgcgtgcagatgacgcactcagtcagcgcctttacttgtacgtgagcgcttaggggccctgtctctggggaccatgtggggcggtggggcgcttgagacagtgtttccctgcatcgtggccggacctctctactcaatccccagtgttctacagtgaacatgaattttataagcagaaagaaattacttttaagagccaggcgcagtggctcacacttgtaaccccagcactttgggaggctgaggcgggcggatcacaaggtcaggagttcgagacctgcctggccaacatgctgaaacccagtctctactacaaatacaaaaattagccgggcgtggtggccagcgcctgtaatcccagctactccagaggctgaggcaggagaatcgcttgaacccaggaggcggaagttacagtgagctgagaccacaccattgcactccagtctggatgacagagcaagactacatctcaaataaataaataaatacataaataaataaattacttttaagaatcaccaatagaaatctgtctttccatcttttttttttttttttttgagayggagtcttgctctgtcgcccaggctggagtgcaatggcgcaatcttggctcactgcaacctccgcctcctgggttcaagcaattctcctgcctcagcctcctgagtagctgggagtacaggtgcctgccaccacgcctggctaatttttttwtttttagtagagacggggtttcatcatgttggtcaggctggtctcgaactcctgacctcatgatccacccaccttggcctcccaaagtgctgggattacaggtgtgagccaccgcgcccagcctttccttccatcttgattgcagtggtgattacacacatgtagacattcatcagaactcatcaaagtatacacttaagtctgtgcattttattacatgtaagtaacacctcaatctgaaaagtatcagggcaacaccacacactgcagaggggcagggctcctccggcagttactcacttcccttgaaacagaagctcaaacatggagtagtcttctgtgactaaacttgttttccgccctcccaacttccaggaagaaccttcttctgaataggatttgaggtaacttaggaaactgctctcaatacggaattttaaagttggtgaggaagtcgacagaaggggaagtcacrgtaggaaaatcaaggtactatcaggatgaagtcagcacgcagagcaaggccagcgaggcccaggcgccaggccttggtccctgcccacctcacccaggccagccagacagcacggactgccctacaaggtcacctcagagagatgggggtgttctctcactgctggcttttgatgagcccaggagggctcagccttcactatcctccctaacaggcatttggggtgcagagatgctgaygcctgaataaggttgggattcggggcccttgggaacactgggcacctggtgggtgggtggaggggcaggacsggctgcagccatgtttcccttagaaacagactgctggaattaacgaactaaacaaatgaaccaaggtgcttcaccccccaaaaaagtgagttttgttctgcgtggagcgattgcctttgggaagccaccaaggccacctgccaacaggcaaatgctgtgctgccgtctgcctggctgactccggccctcccagtcctgcaagctcatggccaggacgataacgatgacaggggcaacaccatggtcctcgctgcccttcctggggcaggagggcccagaagactgataagctaaacccagggcctccctcrgctgcttatctgcccagcacctttcctctaggtcctctcctcccaccagtacaggggtctgggagggggttgcagggggtcctgaaccacagatccctggagactcagtgggagcagctgtacyaggaatcaggcaccactccrctgctgtaagtctkcgtgagagccactggccagcttcctctgacttccctgtcccctcacccaaatcgatgacatcaggagctaatggcccaggctgccctcctgctgcagtgcccataattcttccggcaggccccgccctgcactccacgaccagcctgggttcttcatcctggtaacctgacaatggatttcgtggggcccactctcagtgcccgccagcctgtgtcctgcctggccaggcaatgagtaccggcggcaggcagctgcctcacccctgcatgacccccccagcccaggggactcaatggcgctgtcatcaaaggggcagctgtagatctaggagggacgtggagggggctagccctgggcctctggcattgtggaggctgacctatagagaacagagctggagctggggagacatgaagtctgcacatctagaccccagtgaggagcccaggctttctaggcacaagccccatgggctccccgggcccagcccctaagaaccacggcagctgcgccaggccactcctgtctccacttccataccctccaaaggagaggcacctcccccccccatggcatctccaatctgaggacctgccacctcccagaggaccggaggccctgatgccccaagaattgggcttggaaagatgttaatatccactgccccaagtgccaaggttcagaggcactggtccaggacacacagcagcggggaagtggaaccctcactccagcctgcagtctgggctctgtcactgtgctgtctctccatccttccctccccacaaccagggctgtaggcccacctaacacaccacacacttcccagaaacaggagtcacatccttttcagggctggtagggtggctgaagatggcccaaaacctcctgaatggaaaaaccttgatggggagactgagggccaaggcagaggtttgtccaaggtcacccccagagtggcggatccaggaccctgggcaagatcttcctactgtccaggcctctcccccacctctcttgtgtggcccagcaccctggactcctccatgcccaggtgtgctccccccaggcacgctgggggcagggtgggcagcaggtgccccccaccaggatagtggytcttcctcctgcagaccttcagccctctgctcctggcaggacactgtggccctcctgcccacgttggtgcgggttgaatttgacggcccagcagaattcccaggcagggcagcctggctatcctccctggtgtctcggctctgagagcrgagacccagcctcccagcctggagttgtggtgaattcgcaaacaagtctccatctccagaaccttcctgaagaaaacagctctccaggctggggcaagaagcctgtccctacagtgatacaaccacccctcaataaccccgggcaccacctggcacccactgggggccaccagggagcccaccaagcccactc

SEQ ID NO: 13309 - DNA, 31320 bp, Homo sapiens
agaggagaaacaatacccttgccttcatccaaaatatgtatggaaattactggtcaagtacttcattgatggttccatctaataatgatatggttccgtaaacatttagaaggtttttagatatctagaataggcaaatagacagaaaggagatcactggttgcctggagtcaggggcaaggagaacaggcagtggctgctaatsagtgcagggtttcctctcaggtgatgaaaatattctaaaattgactgtaggaattagctgggcgcagtggctcacgtctgtaatcycagcactttgggaggccaaggcgggcggatcacccgaggccaggagttcaagaccagcctgaccaacatggagaagcctcgtctctactaaaaatacaaaattagccgggtgtggtggcagacgcctgtaatcccagctacttgggaggctgaggcaggagaatcacttgaacccgggaggcagaggttgcagtgagctgagatcacaacattgcactcttgcctgggcaacaagagcgaaactccgtctcaaaaaaaaaaaaaaattgactgtaggaatggttgtacaactctgtgaatatactaatttttaaaaccccattgaattgtacactctacatgggtgaactgaatagtatgccaattatagtgcaataaaactgctaagaagggcatttagaaacaaccgcaacgctagaacaccagaatcccttttttttttgtcagggtctcgctctgtcacccaggctggagtgcagtggcgtgatcacagctctctgcaacctccgtctcctgggctcaagcaattcacctgcttcgatctcctgagtaggggggaccacaggttagccaccacacctcgttaattttttcgtatttgttgttgagatggagtctcgccatgttgcccaggctggtatgaagtcctgggctcaagtgatccacctgcctcagcctcctaaagtgtgggggtaacaggtgtgggccactgcacccggccccctgctaattttgaacaaatttttttgtaggaacaaagtctcactttattgcccaggatggtcttgaactcctggctttaagcgatcctcctgccttggcctcccaaagtgctgagcatataggcrtgagccactgtgccacgcttcttttttttttaaataaattagttgagtttggccctttgtaaatatgtaccaatggaatatatgagctattattaaaaccagatactgttacttctcctttgctatgaytaactttttatttctgcagtatatgttgctctttggtttaggggactaacaactttttaaaaaaataaaatgttatctgtgtcttgcagggctgttacagggggttacgagcaaaatggcacctggccgggagggaggtgggggctgaaccagccccaattcaaccaggaaggggcatcttagtgttcacaccaaaaccaccttcaactggttgtgagctaggggtgctgctatggccagtgggggaggcctttaattctaagtcttacgttctgagtgtgcctctttctaattcaaaggtacaatataaatagactgtgtgacctgcatgaaaacattcctgtttgcaatggcacatctcacagaaagttaccatttttcaaaccacctataatgagaatggatgtcaaaatgggattctaacattttgtaagaccctaaatttatcaaayaaagagtcaaatatgtgcaatgaactcttcctgagacrggaagaaggggcactttttagaaagatattcaacagaagggttttctagttgactgactatcaaggtagagaaaaccctataactccattcattaaaatatgactattaataccttactaaatatccttctacatccttacccacgtttttatacacatgcttttaacacgtgttttaaataacaaaaatgagattccactaaatcaactattttaacctgtcccactcactcccctctttattatactttttgtgtcaagttgatttatttattgaataaataaaatccagacttttctgtttaagtgcctgaatttgttcttacacaaagcaagtgctctcaagaagctcattcttgaagatggttgagaaatatcaatgaccaatatcaaaagaacattaacccatgaaatgtacatgaatatggccacgcgtggtggctcacgcttgtaatcccagtactttgggaggctgaggtgggtggatcacctgaggtcaggagttcaagaccagcctgaccaacatggtgaaaccccatctctactaaaaatacaaaacttagccaggcatggtggtgtatgcatgtagtcccagctacttgggaggctgaggtaggagaacagcttgaactcagaggcgggggtggaggtcgcagtgatccragaccgtaccactgcattccagcctgggcgacagagtgagactctgtctcaaacaatgacaasaacaacaaaaatttacatgaatatgcatatcagctgaaggcaagcacattacaaatgtaagtacaatttagtagaaggggtgagggagcctgggtgtcaatggggaagccttggtgagctcctagaagtaggatgaaggctgtgagacagtctcagtcctggtgatacagtcaggatgatgtaacagggttcagtgagggagtgcaaggtgacagaacaatatggagtatcttatactaattcctgcaaacttctcaactatgtacaagaaaacaaatacttacraaacagaagaaaatggccaggtatagtggctcatacctgtaatcccagcactctgggagaccgaagcagtatcacctgaggtcaggagttcgagaccagcctggccaacatggtgaaacyctatctctrctaaaaatacaaaaattagccgggcatggtggtgggcgcctgtaatcccatctactcgggaggctggggcagaagaacygcttgaacctagggtggggtggaggttgcagtgagctgagatcgagccattgcactccaacctgggcactaagagtgagactccatctcaaatttaaaaaaarraaaaaaaaagaaatagaacaaaacacagcagtggatacagtgctttttggttcattcaaagcagtcccatcagagtagcatattaaactatacaaacggctccaaatggcaaaatctagacagtagaaaatcccaggtcctaattatgttgtcaaataacttacaaaaaaaaaaaaaagatgaaggaagaagctacagattaaaagagatttaacagatttatcaaacaaataaaaaaggacttttggaacctaattcaaataaagttaaaatacatatgacatttacaagaaaactggaaaatctggacagtagatatttgatatcaagaaattcctaattttttagatgtggtaatagtattgggttatgctttttaaaagtccttatccattagagatgcatatagaattatgggtgaaataatatgatgtacagaatttctttcaaaataacatgggaagggcggccaggtatggtagatcatgactgtaatcccagaactttgggaggctgacatgggaggatcgctggtgtcaaggagttcgagaacagcctgggcaacatagggagactgtctttactttaaaacacacacacacacacacacacacacacacacacacacamacamacacacacacacatacaataaaaaataataatatgagaaaggagaagtggataacgaaagcacagacaaaagaagactgggcttgagctaaatcactgtggaagctgtgtgatgaggacaaggggtttcaacagattattctgtttttgcatatagttgaaatccttcataataaaagttaaacaaaaaagtgctacaaatcctaacgctgacactaaattctacagcatgaagaatttatggaagagtgagactctgtcaaaaaaaagaaaaggttgtggaaaattacctaatgatacaaaaagtataataaagggggtgagtgggacaggttaaaatagatgatttagtggaatctcatttttgttacttaaaaaaagcatgtatcatgtatataaaagcatgggtaaggatgtagaaagatacttagtaaggtgttaacagtcatcttttaatgaatggagttataggcttttctctaccttctttattacgtttaagaatttaatgataaaaagtcacgcatgttgtttcaccccagcagtgttggctttactaaaaacacatactctaagaatcccatacatgaaaggtggaacttaatcaagaacatgtcagagagaagctgcttgagcaagaaaatatctgaaaagcaagctctcctagaagagaagcaaggcctccttaacagtttatargcacacacctgttaggggcacatactgcctgccagtgcctttcactctaagtctctctgtaagctgtaaaagcaaacagtttaatggcaaatacatactctatccaggttaaggtgccacagatttataaacgtgtaaaaacaccagaccttgttttggggttaaggtgagaaaagggcttgctaaacagtctctttcctagaaggaagttctcttacccactcactccctgggacagaaggtcaaagagcatctctggttggaatcataatgcttcggcctgaagtgaccaggccactcactactttagttgcccaagcagtatcaaaggagctcacctcatagtctttccttggaagaatctcatcctcctcctcctgtgtttctccaaggatggtctagaaamacagatccgcagagggagccttttttagtggttaggagtggaaggaggcagaagtatttactgaaatcagtggctagcttctaaatcatctggagccattatcaaataggaaccagccctcaaaaaaaacctttcrggggtgagggaccatgtgggtgaggatctacagccatcagctgagctcttcatttccactgatagtctccaaataaccaccctcctcttcaggacacctcaaagatgtccaacgccagctgaaaaggggggtaaaaatgcaggttccatttgacagtgtgacgtatctgaaatcagaaaggacttgtcaactctgggaacacaactcaagttttcccaggatgctttgcagggggaagctggactgtcagtgacccagaaagggtgagggatagagtgagaaaggactggagaagctaaaacagcagcatgataagcacaaagtcctgtgaggaagctcattctgaaaacgcttgtttcattccaaactcttttcagatggaaataaaaggaaacatgggtgggatttactggagctggcctggattctccctcagattccaggaggggttatgagaaaagaccccagacttaggcacgtgaagcagggtagacgcttcgagagccctggctgcggtccccaggccccacccgctgccacctgcgggcccagattggcccggccccacccccggcaacgcctctctcagtccyttagcaaccgccccctccccaggccgactccgccggcttcttaccagctcctcgggggtgcgggtctcacgctcaccgcagcagcagcaccacctgcagcagcagcacagagaccccctgcaccccgccatcttcctcctttactgccactctggacccctctaccaaccccctcccagccaggatctgcgcctcacgtgactggccccgggacggtcacgtggccctctcgagctctgggactgagaccaggagtggctgcagacgrgtggggcgaggactcgcgtcacatgacgataaaggcacggcctccaacgagacctgtgggcacggccatgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggagggtgagtgacggcgaggccggggtcgccgggagggagatcctggagccggcaaacaacctcccgggggcaaggacgtgcttgtgggcggggagcgctggaggccggcctgcctctcttcttggggggggctgccgcctcccytgcgcacccttcgcgggattagtgtaactcccaatggctaccacttccagcgaccgccaaccctcaagcgaagactgactttggctccctgcctggacggaggggcccctgagccaggggtgacgatcccgcccctctgaccggcccaggcccgtgtcctcgcccccatcggtgactcagtgacctggtgactggattctcggccacctgggcgccgagacggcttccggctcctgccttttaaacctgcctccccggcgakcacctggagaagagcgctgggcccggggcactgcggtccctggcgcccactgcgtcccgctgcgcacgggggtccgccgggacctttctgggagtcgtaggcttagtatcccagtgcttggcgcagactagttgttcagtaagtggcagaggcttattttgagagagtggcagcacctggccctttggcgctcagtgaatgttggctatcaccgtgtgccaaactctggggataccccaggcaggacaccggtcctgtctcagggaactggggaaagagaaaggagacaggycttttcacccacagttacaacccagggtgctatgggagtccagctgataacggataaatcgtgggagttggcttacaaatatggcacatgcgtggcatatactaggaatgcaataagtctttgaaaatcagagggtttacaggtggttcagcttcctcctactctaggttctgttccagcaagcaattaacgaggtgcgcccttaaacgctggaggaaagccaactggctgctcttgctgttactcctcccccccgcccccgttcctcactccccacagccatccccactgagaatctggagtttgaggtcagaatgaaagagagcagccctagagggagaaagctttggcccagggttcttagtctggaatcaactccttgtctttggatgtatccccgtgtagtctgtgcacctgtgtgtgtatttcaggggaagggagcagtgcatttaatcagattgtcaaaagagtctaagaccccaaatggttaggtacacagggttagtggtggacagtctgaaagaaatgaacctcacctgggctttcctctgttgtgccatgtcaccacacacccattcactactgtgtgtttgcccattgctgtgcaagtgttttgtttgtttttaagtgtttgtcttattttcttaaccagactgccagatgrccctatgccctctgttggcctgtctgtgccctggtggctctgattacttgtttctgtttttkgtttttgktttttttttttgagayggagttttgcttttgtcgcccaggctggagtgctatggcacaatcttggttcactgcaacctctgccttccgggttcaagcgattctcctgcctcagcctccagagtagctgggattacaggygcccgccaccaaacctggctaatttttatatttttagtagagtcgggatttcaccatgytggccaggctggtctcaaactcctggcctcaggtgatccacccacctcggcctcccraagtgctgggattacaggtgtgttttttgtttttttaagagatggagtctcgctatgttgcccaggctggccttgaactcctgggctcaggcawtccttctgcctcagccttyccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacackgtctttttggagtagcatgaattcaggagaaatctggctgcatagtcaagccctcaccccttccatcctrtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggamcatcgaaaagccagggtcctcccagctgggcactactgcccctcgctaggaataygggcctcgcaggtcggcagcgtgaggtcctctgtgccaccttccatcaggtagctgtcaccgaggagcatgttgcagtgccgggtgggggctgccttgcatgcaaggagcctggcagcagcggagggcaaggctttgagtgaggcggcccggacagccatagctgaggagcatggagccactgggagggggcagtgtcaccttttttggccttcttcctgtgtggaaatacagygcctccggcttgaacctgccactcaggtgtcttgatgtgtcgggggtgtggctgcctgccccctgatgctccctgccccaccctgtgcagtaggaacccagccatggtgaacgaagccwgaggaaacagcagcctcaacccctgcttggagggcagtgccagcagtggcagtgagagctccaaagatagttcgagatgttccaccccgggcctggacccygagcggcatgagagactccgggagaagatgaggcsgcrattggaatctggtgacaagtggttctccctggaattcttccctcctcraactgctgagggagctgtcaatctcatctcaaggtraactcatgcaaggttaaggtgggaggcgggagtggtggtgcctggggagcaaactgtcagccctgaggctgggctgccctttaacccggcagaaaaaagcagccggagggggcaggaaggagaaggcagagtgggtcatctgatctgcaacttctctgttgcctgtaaaagtccctccacagtgtcaaggtattttagacacactcttcaatgggttaaaaatgttgattctcacactgtattctttgagggaacttgggggctggatcacgagtgcagtttaggaagtcacaaagcagtgagattgttttcagcaagttagaaatttggattatgcttcttgaactctagaaatgccaactgaattacattagcacttcatgaattgcagttttttttttaagtttatgccttttactgtatgcacgtctcacgtgtcactcccaagtttttgaagtttaaatgcacaaggatgtttaaatacaccgttgatagcttgtaacacaagtactcgtgcacatccaggcttttttttgagtctcgtttcggaacttggccttggtctgcataactgtaagctgctgcacagggcttggggggtgryatgaaagaaagtgagtctgctgaccctctttctaactgttcctacagcgaggctgtgcttgccacagttaggattcccctaactctcaatcatgatgtcttaactcacctgagatartaaacaggcaagcgctgtgaaaagtctgaagtgctgctctcacacaaaatgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctggagtgcagtggtgtgatcttggctcattgcaacctctgcctcctggctcaagcaattctcctgcctcagcctctcaagtagctgggattacaggtgcccaccaccacacccagctaatttttgtatttttagtagagatgaggtttcactatgttggccaggcggtctggaactcctgacctcaagtgatccactcacttcagcctcctgaagtgctgggattacaggcgtgagccaccacgcccagcatcctagtgttattatgaagtgggtactactatctgccgtgtcttataaataaggaaacagaactcacagagattaagtaatgtacccaagatcacacagctataagtagcaaagccaggatatgaacgctgattggtctgtctccaaccttcattgatgcttctctaactcccgggccccatgggaaggcagtgacggatggtatttctcctggaacctctcttcagaaacaaaccccctacaggtttgaccggatggcagcaggtggccccctctacatagacgtgacctggcacccagcaggtgaccctggctcagacaaggagacctcctccatgatgatcgccagcacmrccgtgaactactgtggcctggagaccatcctgcacatgacctgctgccgtcagcgcctggaggagatcacrggccatctgcacaaagctaagcagctgggcctgaagaacatsatggcgctgcrgggaggtgtggagccagcactcccctacactctgggttctggctttcccggaggccacttggtagcctgaacttggttcctgaaatggtcctttacttcytcctgggccccacgctgaggatccgcaggatcccatccccgccagtagtgtcagtaggcattgtgggtagtgagtcatcctgggcaccacacacaggcagccacctcttccacctcttgacctcgacataggagttccgtcaggaatgcagtcgcggcctgataaccctctgccttgcctacaccactgcatcgattgctggctgcacccagcacttggcccaatcacagagtaacagagtatccaggagtgagaatagccggtcaggcctctggtgcccgctgttgtcaggccacctaagagtgggaagagggagcctgatgggtgggatcctatggcctcgtgctccctaccacaagaccccttcacttgagatgagtagaaaattctcccaggaggcaggagccccaaggccgtgggatgggagagggtggcaggcrtgcccaggtagaagtagggaagggctctccaatcctccaggcacggtgagaagcagcggtggtctcctattctccaccgccagcacagggtcagcatgcagtgaatattgaactggtgggctgcttttttccctcctgctgtcttaccaagtgctagaaagagacgaaccaaacctaaataatatgaagtttctgccttccagggactcgcrgtcctsggtgtcrggrctaggtagagggaacagaaagggtctctggaggttgggtgagacccagtgactatgacctccaccaaccctgcagacccaataggtgaccagtgggaagaggaggagggaggcttcaactacgcagtggacctggtgaagcacatccgaagtgagtttggtgactactttgacatctgtgtggcaggtgagtggctggatcatcctggtggcggggatggagctagggaggctgagatgcccagagagcctgtcggtgttcggttcaggacacagtgatcaggggcactcatgggtccatgctggatgaaggacatgcagaggtgaactgcaccrtgyccttgctccttttgtatcacccactcccctcctgggcctgccaccatcgacccctagctttttgttcctctgcctggctgtgcccttagcctgcttggccttattcttttctttaaaacgaaagaggggtctgggcgcggtggctcacacctgtaaccccaacactttgggaggccgaggcaggcagatcacctgaggtcaggagttygagacctgcctggccaacatagcgaaaccccgtctctactaaaaatacaaaaattagccaggtgtggtggtgcacggctgtagtcccagctactcaggaggctgagccaggagaatctcttggacccaagaggcggaggttgcagtgagccgagatggtgccgctgcagtccagcctcagtggcagagcaagactccatctcaaaaamaaaaaaaaaacaacaccccacaaaagagggatatttactaacaggattccagagggcagggaacccaagatcaggagatggcctcagacctcacaaggcactggaagaggtcaaaaagcaaggccctccctcattccctctggggccacagggtcccccatctccgcttcccactgcacatctgtgcttcatctgggagacctgatacccatgcttttccacacacctggcctgctcctgagtgtgcagagtgtcagttccagccagttccccaggctaatggacaggcctccgttccaaattcccaggaaagagaatcaccattggccacagccacaagaccaggttcccccaacagaaatgggtgggttggacttctctcccacccttgaagctgaaggctggcattgagccctcagcgtctcagacagcgctcaggtatggcaagacagtgtgcaccagggacaggaagtcccgggattggcacattttctgggatgacagtttttttgccaatattctgggagaaatcctaccatttttatattaaacatggctatgttatggagtagcatctaaagtgatatgaactaaaaaaaaaaggccaggtgcggtggctgaagcctataatcccagcactttgggaggccaaggcgggtggatcatgagatcaggagtttgagaccatcctgtccaacatagtgaaaccccgtctctactaaaaatacaaaaattagcygggcatggtggcgcgtgcctgtagtcccagctacttggtaggctgaggcaggagaatcgcttgaacccaggaggcggagcttgcagtgagccgagatcgcaccaatgcactgtagcctgggcaacagagccagactccgtctcaaaaaaaacaaaacaaaaaacccaaaaaacaaaccacgtggcttcaagaaaattacatgttgtgagtaactttggccttgtccctaacccccgatggacatgtccattctgtcaacaggggtgtttaggtgctaagtctgggaagcrctgattaggagtcagagaacagacatttccaactgttaaattgtcatcgcttgtatcagccattatatagtcagttactgggggaatatgcacccgtgatgggcgttaggtgataatgattggaaactagtgaagctgtgagctcacagttgctgaatggtttcttactttgcttatcaagtgggtaatgaagatgagtggattagaaaacaccaacctgttgggcatggtagctcatgcctgtaatcccagagctttgggagactgaggcaggagatcaagaccagcctgggcaacacagtgagaccgtgtctctacaaaaaataaaaacattttaaaaaagaaagccctcagctgttcatgatagaaaaatagagtaaatagcaaaatctatacgtaatcaaatgctagatttgttcggtgatatttaggtattgtagctatacttttcagctattaaaaagccttgttgtttctgaaattcctactgggaaaatagctttgttattgcaagtgtgaagccccattgctttatcccccactcccttaccccttgaaacaatagtttttatattcattttttgatgactctgggtttcttaagaacggaactgccttatcagagcaaagcagcttggccttccgcctggctcagagtcctgccctgggcttgggctgatgaaaccagcactccatgtagtttcatgaaggcctatggtcrtcctgcttgcctgaccgagcaaggcggctagtaagtttagtcattgaggaaaggggtcagagagttcacagagccagtaaggagcctatgggacatctgatcccacctcctaagcaattctggaatcttgtcttcagcatccactgcccctgtgttttcagactccaggagctcattgttttgtgagtggcttatagtactctagccagctctctgaaccggatgctggttctgccattrgaaacaacacagaatatgactaataaagaacttcactagggggctgggtacagtggctcatgcctgtaatctcagcactttgggaggccaaggtgggaggattgcttgagcccagaagttccagacaaacctggacaagatagcaagaccccatctctaaaaaataaataattaattaaaaaaawwttttttaattagccagatgtggtggcttgcatctgtagtccaagctactcaggagactgaagtgggagatcacttgtgcccgggagttcaaggctacagtgagccatgattgtaycactgcactctagcctgggtgacagagcragaccctgtctctgaaacaaaacaaaacaaactcacctatggtggatcctttttccccaggacagacctttggacatttgaaaggagtttctgtattcttttcattcttttttttttttttttttgagacggagtttcrctctcgttgcccaggctagagtgcaatggtacgatctcggctcactgcaacctctgtctcgtgggttcaagcaattttcctgactcagcctcctgagtagctattacaggcatacaccaccacacctggctaatttttgtatttttggtagagacggggttttaccatgttggccaggctggtctcgaactcctgacctcaggtcatcctcctgccttggcctcccaaagtgctgggattacagacatgagccaccgcaccctgccatccattattttctttgaagaaaacatcactttcttcagttcttccttgtgtaacttggtttttagcttttcactatcttggacccctgagtaatttcagtgttacattaaaaacaatgtttaatccggtgcctagagaaaagtcaagcttastaccccagatgctgcccagccagtgctaactgtagcattttctcttttctatggccaccaagtgcaggcctgatttgcttggctgctcaaggcaggacagtgtgggagtttggagcaatccacccccactcttggaactgggctctgagccacctcccctgagagtcatctctggggtcagaagcatatcagtcatgagcccagccactcactgttttagttcaggctgtgctgtgctgttggaaggtgcaagatcagagcccccaaagcagaggactctctctgcccagtccctgtggtctcttcatccctcgccttgaacaggtggaggccagcctctcctgactgtcatccctattggcaggttaccccaaaggccacccygaagcagggagctttgaggctgacctgaagcacttgaaggagaaggtgtctgcgggagycgatttcatcaycaygcagcttttctttgaggctgacacattyttccgctttgtgaaggcatgcaccgacatgggcatcacttgccccatcgtccccgggatctttcccatccaggtgaggggcccaggagagcccataagctccctccaccccactctcaccgcaccgtcctcgcacaggctgggggctctgggtggagtgctgagttcgctgagttcttcccagatctcctctcaggtccagaacttgcacagcgttgcttggccaccccattttggttacctctaattttccccccaaaacccagcaacagtgtctgttgaggggtttgttgtactttggccaacaagcatcaccaaaagggattctaattctcattacaaatcctgcttaaatcagtgtttcccaaaggtggctgtcatcagaaccacttgataagctttttcaaaaagtggatctccaggtcccacccctggaggttctcactcagtaaatctgagggaggtcctyggaatgtgtgttttacttcttgagcttggcaggtgattcggatgatcagtgcagcatgggaacagctgggttagatgacaccatgttaccaacagacacatctagggctaaaaggctggctcaacccaaggctggaatgcttagggcagctgctctactctgtaaaaagtgggaaagctgggcatagtggcacgtgcctgtagtcccggctacttgagaagctgaggcaggaggatggcttgagccctggcgtttgagagcagtgagactcagtctctaaaaacagaaaaaagaggagaaaacggcaggccaagcccaggtgtgctcctagaatatgatcggactttcgtgggtccctctgcctgacactgtggttggcatggatgatggaagggggagaagtatttagggtgggagacrggctggccagcagccgccacagcccctcatgtcttggacagggctaccactcccttcggcagcttgtgaagctgtccaagctggaggtgccacaggagatcaaggacgtgattgagccaatcaaagacaacgatgctgccatccgcaactatggcatcgagctggcygtgagcctgtgccaggagcttctggccagtggcttggtrccaggcctccacttctacacccycarcygcgagatggctaccacagaggtgctgaagcgcctggggatgtggactgaggaccccaggtgagggcagtggcccagagatccccagaggagggtccaagagcagccccggctgcagtgctggctccccacggtggtacagrtggatgtctgtgccatggctagctgggcacatcraaggctccagtctcagagggcatcagatggaagaactcagcctcaggggtgctcccctgcttccggctccctctagccaatcccttgtctcaattctctgtccccatcctcrcccaggcgtcccctaccctgggctctcagygcccaccccaagcgcygagaggaagatgtacgtcccatcttctgggcctccagaccaaagagttasatctaccgtacccaggagtgggacgagttccctaacgrccgctggtgagggcctgcagaccttccttgcaaatayatctttgttcttgggagcgggagggcagaagaagtttgcatgcttgtggttgacctgggaggagtcaggggcagaatttacagkaatggcctcctgggcatgtggtggcactgccctctgtcaggagtgtgccctgacctctgggcacccctctgccaggggcaattcctcttcccctgcctttggggagctgaaggactactacctcttctacctgaagagcaagtcccccaaggaggagctgctgaagatgtrgggggakgagctgaccagtgaagmaagtgtctttgaagtcttygttctttacctctcgggagaaccaaaccggaatggtcacaaagtgagtgatgctggagtggrgaccctggttcatcccctgcccctggcctgaccccagctgcaggccaggctgcggggctgtgacttccccatcctgtgccctcccctccatgctgtggacatggcaaagggagaagggtaagttgggagacctccacctggaagggcttagggaggcaaagacaggctgggtctttgttgggggccgtgagagggactcagggtgccaaacctgatggtcgccccagccagctcaccgtctctcccaggtgacttgcctgccctggaacgatgagcccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggtgtggtagggaggcacggggtgcccccctctcttgaccggcacccgtkggttccccagagcttagggcagagcagcctgcctctcctgggctcttaaattttgaatgagcatggattggagcggatgggagctcatgctttaagtcagatagacctggctgggcacggaacccggccagcactttgggaggccaaggcgggtggatcacttgagcccaggagttcgagaccagcctgggcaacatggtgaaacccattctctacaaaaaatacaaaaatgaccgaggcatggtggtgtacacctgtagtcccaggtacttagggggctggggtgagaggatcgcttgagtccgagaggttgagsctccagtaagccatatttgtgcctctgcactccagcctggcccacaaagtgagaccctgtctcaaaaaaaaaaaaaaaagattggctgggcttggtggctcatgcctgtaatcccagcactttaggaggccaaggtgggcagatcacaaggtcaggagttcgagaccagcctgacaaacatgatgaaaccccatctctactaaaaatacaacaattagccgggtgtggtggcgggcacctgtagttgcagctacttgggaggctgaggcaggagaatcgcttgaacccgggagacggaggttgcagtgagctgagatcatgccactgcactccagcctgggcaacagagcaagactccatctcaaaaaaaaaaaaaaaaaagatagaaatcagacctatggaggcaggtcactcgacctctctgagcctggttttctcgtctgtaaaatgggatgtagcttgtgttctgggcatgaaacctaacaaagcatgtaacgtgcttggcacatggtaagagcaggaagcactccctgaaaggcagctgctgttactatcctgagttgacacctttctcccagggctgctggagttaacattatgttctgatctaaggcccacrggccctggagcagaaagacctgagtttaaggaccagctctactgtttactgtcagagtagccaacgtgctcaacttccctgaacccactttcctcacgtggggctcactgtgcccagcctcccgtattatcagcattctagcaaatgagtttgagtaaacccagcttaatccctgataggcactggttctagaggagatgtcaatgtcattgtcagcttgcactggggaggatggaatgtgtggggcctctctcccatgactcggcctgtcaaaccagttgctgctgttcagaaatggcttcttcgtggagtcttccctgactgattgggagaggggtggctgatagccctcagacctgtccagactgagaaactcacgtccccactcccctcaccctttgcttatggacgtgccaacgccacagttcattattccgcccacatkgctgccartagtcctgataccttaggtgtctgcgaaagggcgtctggcagggctggggttggtgacaggcacctgtctctcccacaggcctacttagagtttttcacttcccgcgagacagcggaagcacttctgcaagtgctgaagaagtacgagctccgggttaattaccaccttgtcaatgtgaaggtaggccaggccccagggttcccacagagtaycargcccttcgttgagcaaacacccagcacctagcctgggctaggcattgtgcaagacagasagatacaggcagaactggggccctgctcttaaggagctcccagcctagagtgagggaggcagatcaatgtgtgaccaccagccagtgtaagtgggaaaatcaagttcaggagaggatgctgtcrggtccaraggagggatatctcacctgggaggccagggaaggcttctcagagggtcatctgtgggaatcactgaggasaaagaggagttggccaacaggagagaagggtattcctgggacagggcagaggacaggcagaggcagtgagctgcaccatctggggaaacsgggaacatgagcaggaggaggcgggagtgttaagcaggggccaggcccgcagagatcatggttgtcctgctggaatttgagttttccctcaatgcaagggaagcctttctccagcagtggggtggcttggttcctgctttattttaggcaaatcacagtggatagtcatacggatgagagagattggggacggctagagccggggaggccagtgaagagacccctggagtgacccaagccaaacacactcctggaggtgggctagacaagagggaatggatcagagagtgagcagggggtgctcaaggaggagaggggaagtggccaggacgcctctaggttcaggcttgtgtggggagagatatcattcacagatgcaggcagaggaggccaggagcggaggcacagggagaggggagtggaggcgcagggagagtgkaggccgggagtggaggcgcaggcagagggtattgagcccagacagcctcattgagtcaaggctgtccaggcagtgggactccagttrttcttggcccaggtcttacccccaccccacatcccctcagggtgaaaacatcaccaatgcccctgaactgcagccgaatgctgtcacttggggcatcttccctgrgygagagatcatccagcccaccgtagtggatcccgtcagcttcatgttctggwaggtaaaggagccgggggcaagcttgccccgcccacctggaaaaccgtsgggagggattgggaccaagtcccaagcgtgtrctgaaggccacactggacccagccttcagggcacacccagctctgactcacccatgtcactgctgaygcagggtgtttatttctgggcaggggtgggaagtgatactggcagtgggccttgttctattccgggaaatgtcctgttgagcagagcccttggagagccctgttaatcttgcctstgtgtgtgtgtgcatgtgtgcgtgtgtgcgggggtatgtgtgtgtaggacraggcctttgccctgtggattgagcrgtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaayggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacmcttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccargcccccaaccccgcggtgctcyggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgyggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgsaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagagkttaaggtgggtccaggaaggcagctgctcttagtgcccgcytaggagttgagtacagtgaggagggtggaggaaggtgctgagcttagccttgtgccctgcccccatctccccaggcctccagcctctcmcggctgcctgccrcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgygggtctgaaggartagccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaaygtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctrtcaacctcttatcaccayttgttggtgtcagaactaactgcttctggtctggagagggactgaccgatgccyttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcrtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgacaaaaaaatgctactgtcctcgtgtacctattctgatcctcaactgcaccgtgagaaagcatgcatttcaatgtctccctaacaggctgtgacccaacatgctggtctttgcggccggacctgcagtggcctggcactcgagaggtgccaggttcatctttgctgatggattcagagttgcttgtcagaggctgactgagaactggggagaggtggtgcatacgaggttgctgggcccctggggaggcatccagccatgctgcyaccacsggctgaatcaagctgattctaaggccggtggtccgagggtcatttttggacctcccgccctgcctaggctcccttcacctgtttccaaggggctggggcgtccagcagcaggctccccctgctggccatccggggccagagcgtgaggtcagtctggggcttggggcgtaccttgccggcccctggcagtcccagccgcaccctgagctgcactgtccgcaggaagcgcctgagctcagccggccggagctgggtgaggatggctcgctggacaccgccgcgcaccgccgactgcaccgaggcctctaggaccctgcgggagaggaaggagtctgcagccagggccatmaaggccaggactctctgcagggagcccccccagtgccctgcgggagggggccttcygggcccagccccaggctggggcccacccacctcccacactcccttttctggagggagaatctgggtaaacaggatggagagcgacctggaaggagaaaatcacagacggggacaagcatcctgtttaggggcagagaggggacagtcctgccagtgccactttgcctccccttccctggcaagagcgcgtttatggcgcttgctgagtggctggctgtgctggtgactgcaaggcatgaccattagagacttccccaaggaggggacacacagcaagaggcggtgycaggatgtggcccaggactagatggccagggcggcctctccctgtcacccccaaccaccctcttgagcctttgccctgccacccagccatgaattacgctctacccctgccaaaaacaggcttgaggcctgagctggaagcacagagtggggctgcacttagaccacagcactcaccaggctcgcggcttccaggaagcatgggctcggctgacctggccccgacaggactcatgcacccacagagcccagcaccaagtccagcactgggctgcctgggccccagcgctctctcctgcctgctgctgggcctcatggtgcatgcccggggccactggccatgctgggaaggcctgtggggcccgggccttcttctgctgcccatcttcctggccttgctgccygcagcttctccagcgggcaagggaggcctgggccacacgctgctcctgtgccccggctgccacttcctgggcttcccgccatgtggcaaacacrgcccccagtgctcttctcctcaggccatcctgaaaggcttgatgctgggcccggagcacccccgtgtctcttacaacctcacaccaggcctggaagtagctgcaaaacagacacawtgggccaggtgtggtggctcatgcttgtaatcccagcactttgggaagccaaggtgagtggatcacctgaagtcagtttgagaccagcctgaccaacgtggtgaaaccccgtctctattaaaaatacaaaaattagccaggcctggtagtgggcacctgtaatcccagctacttgggagtctgaggcagaagaattgcctgaacccaggaggcagaggttgcagtaagccgagatcgcgcaagtgcactccagcctgggtgacaagagtgaaactccatctcaaaaaaacaaaacaaaaacagatgcatgggagggcttgtctcgttctcagagtcaaaagtcacatttattcaaagttacacttgcaaatctcccacaaaacagtaaacgaccagtaacaggtgaaagcactggctttccatcttgcaacctcagcctcagagggcaggggctgccctgcgagggggatgggaaccagcagtatgggttcaagtcccacatcagccatgccctgcctccyatcacatgcccaggtggttggtgagggagaggaacaccatctctcactcastgagaagccaagaaaaaaaaccatctacggccaggcacagtggctcacacctgtaatcccagcattttgggaggcagaggcgggcggatcacctgaggtcgggagttcgagaccagcctgaccaacatggagaaaccccgtctctactaaaaatacaaaattagccaggtgtggtgccacatgcctgtaatcccagctactcgggaggctgaggcaggagaatcacttgaacccgggaggcggaggttgtggtaagccgagatcgcgccattgcactccaacctgggcaacaagagcgaaactctgtctcaaaaaacaaacaaacaaacaaaataaccatctacaccctcagatgcaaaagcacagacgtcagccattctgtagccaacagttcactgccccacggggacactgaacattcgcaaatttgtactgaactgtgggaggagccattctgtgtcctcygcttggttttacaatatgcattcatgaactgtatacatgttccaccagaacatctttacttaaatgaagatttcactctcttctcttagcgacagtgtacagcagaattctccttgctgtaactcctcacaatgggcgttatggtagatttccgaggagtggatttctcctcctttttttttttttttttgagatggagtctcgcactgtcgcccaggctggagtgcagtggtgcaatctcggctcactgcaacctccgcctcccggattcaagtgattctcctgcctgagcccaagtagctgggactacaggcacctgccaccatgcccgtctaatttttcatatttttagtagagatggggtttcaccatgttggccaggctggtctcgaactcctgatctcaagtgatccaccttcctcggcctcccaaagtgctgggattataggtatgatccactgttcccagctgatttctcccatcttaatcatatcctctaaaaccaaagaactgacctggccaggagctggactcccggggcttgttggggccacaggttaggggtggggtttgccaccactcccaaaataggtaataaggtgtcagtggtcatggccctgtgtttccaggctaggatctcccttcatgccccttttttcccaggccacaggcctcctatctgggccaccgtctgagcttcccaccccctgggtgctctccttgctattccttgcgtggggaggaccaacaccctcccacccccaggcccacccacctctgcagtagcagctgctctggccgggtcactgtgcatctctgatgagctgctgcctgctgccagctccggaacaccaccttctgcaggccctggaggtggacctgcacccatgtctggcacttttcatgcaggaactgctgccctggggccagagagatgctgaagagccactgggtgctcaccccagcctctccccatgggcctctacgcagccagcccttcgccccctaccaggtgggaacasaggaggccaccctgactgtctgggttaaaaagcctctattatgggtgtcctgctggtgaccaggccagcccagctcatagagttgttgggtttgtttttgtttgttaattttgccacagtattttcaaatctggagaattcaggtaaaaatctaattttctatttttttttttttttgagacggagtcttactccgtcrcccaggctggagtgcagtggcccratctcagctcaytgcaacctctgcctcctggattcatgccattctcctgcctcagcctcccgagtagctgggactacaggcgcacactaccacgcctggctaattttgtgtatttttagtagagacggggtttcaccatgttagccaagatggtctcgatctcctgacctcgtgatccgccagwccgggcctcccaaattgctgggattacaggcgtgagccactgcgcccrgcccaaaaatctaattttcaatttttctgtaaaaactagaagttctggaaacactggctcagtgttcctgccggggaatgattgggctgcataagcagctgtctccagcggacaggacatgactttctagaaccaccacagccctgcctgccagctcattaatgcratatgtcggtgtagtgggcagcctccaagacagcatcctgtgttcgtgtcctgggcaatgccccgccttgaatacaggctgggtttactaatttgcttttaacagacagaatttggcagaagcaatgggatgtcacttctgatatcaggttataaaragactggttggggcygggtgcggtggctcacgcttgtaatcccagcactttggaaggccgaggcgggttgatcacttgaggtcaggagttcgagaccagcctggccaacatggtgaaaccccatytccactaaaaatacaaaaattagccaggtgtggtggcaggcgcctgtaatcccagctacgaggggagytgaggcaggagaattgcttgaacccaggggrtggaggttgcagtgagcyaagatcgcaccactgcatgcctgggcaacacagcgagatcgtctcaaaaaaaaaaaaaaaaaaaaaaaaagactggttgggccatgcaacagctctttttgcccagaggccaagacccagagagcaagcctgccttgggaccatccctcctcccttcactggccacattcctcagggcttctarcacactgcaccctcagccagcctctgcaaatccagtccttcccactgccctattttgctgaccccttcccacgcctcaacytctctcgccactgctctgcccgctgagccctcctcacctcctcctgggaccctccctgactaactctgctggcccctaagggcaccatgactctgcccacttctctcccaactcagggctccgaccagtgactcctagaggccaggtgaggataaggatgaagataaaggtgatgacatagggactacattatccccattttacagatgtgtaag
